United States Patent
Schlachter et al.

(10) Patent No.: US 11,421,210 B2
(45) Date of Patent: Aug. 23, 2022

(54) CHIMERIC AND OTHER VARIANT BETA-GLUCURONIDASE ENZYMES WITH ENHANCED PROPERTIES

(71) Applicant: INTEGRATED MICRO-CHROMATOGRAPHY SYSTEMS, INC., Irmo, SC (US)

(72) Inventors: Caleb Reece Schlachter, Irmo, SC (US); John Tomashek, Columbia, SC (US); Lim Andrew Lee, Columbia, SC (US)

(73) Assignee: INTEGRATED MICRO-CHROMATOGRAPHY SYSTEMS, INC., Irmo, SC (US)

( * ) Notice: Subject to any disclaimer, the term of this patent is extended or adjusted under 35 U.S.C. 154(b) by 0 days.

(21) Appl. No.: 16/596,568

(22) Filed: Oct. 8, 2019

(65) Prior Publication Data

US 2020/0109386 A1    Apr. 9, 2020

Related U.S. Application Data

(60) Provisional application No. 62/742,779, filed on Oct. 8, 2018.

(51) Int. Cl.
| | |
|---|---|
| C12N 9/24 | (2006.01) |
| C12N 9/42 | (2006.01) |
| C12N 9/34 | (2006.01) |
| C12N 15/56 | (2006.01) |
| C12N 15/70 | (2006.01) |
| C12P 19/14 | (2006.01) |

(52) U.S. Cl.
CPC ........ *C12N 9/2402* (2013.01); *C07K 2319/00* (2013.01); *C12N 9/2445* (2013.01); *C12N 15/70* (2013.01); *C12P 19/14* (2013.01); *C12Y 302/01031* (2013.01)

(58) Field of Classification Search
CPC ....... C12N 15/80; C12N 9/2445; C12P 19/14; C12Y 302/01031
USPC .............. 435/69.7, 137, 138, 72, 200, 252.3
See application file for complete search history.

(56) References Cited

U.S. PATENT DOCUMENTS

| | | |
|---|---|---|
| 4,994,390 A | 2/1991 | Wiatr |
| 5,071,765 A | 12/1991 | Wiatr |
| 6,391,547 B1 | 5/2002 | Jefferson et al. |
| 6,641,996 B1 | 11/2003 | Jefferson et al. |
| 6,664,097 B2 | 12/2003 | Russell et al. |
| 7,087,420 B1 | 8/2006 | Jefferson et al. |
| 7,141,719 B2 | 11/2006 | Jefferson et al. |
| 7,148,407 B2 | 12/2006 | Wenzl |
| 7,176,006 B2 | 2/2007 | Jefferson et al. |
| 8,491,891 B2 | 7/2013 | Roffler et al. |
| 9,719,075 B2 | 8/2017 | Lee |
| 9,909,111 B2 | 3/2018 | Yang et al. |
| 9,920,306 B2 | 3/2018 | Lee |
| 2003/0003562 A1 | 1/2003 | Russell et al. |
| 2003/0157684 A1 | 8/2003 | Jefferson et al. |
| 2004/0091922 A1 | 5/2004 | Russell et al. |
| 2005/0153448 A1 | 7/2005 | Wenzl |
| 2005/0227306 A1 | 10/2005 | Fox et al. |
| 2007/0037246 A1 | 2/2007 | Butt et al. |
| 2007/0081986 A1 | 4/2007 | Tomatsu et al. |
| 2009/0041741 A1 | 2/2009 | Sly et al. |
| 2010/0129367 A1 | 5/2010 | Roffler et al. |
| 2011/0237506 A1 | 9/2011 | Garigapati et al. |
| 2013/0011381 A1 | 1/2013 | Sly et al. |
| 2015/0086526 A1 | 3/2015 | Xie et al. |
| 2016/0090582 A1 | 3/2016 | Lee |
| 2016/0237415 A1 | 8/2016 | Lee |
| 2017/0267985 A1 | 9/2017 | Yang et al. |
| 2018/0067116 A1 | 3/2018 | Rozas Andreu et al. |
| 2020/0002458 A1 | 1/2020 | Kajita |
| 2020/0024586 A1 | 1/2020 | Lee et al. |
| 2020/0040319 A1* | 2/2020 | Tomashek |

FOREIGN PATENT DOCUMENTS

| | | |
|---|---|---|
| EP | 1175495 B1 | 10/2006 |
| WO | 00/55333 A1 | 9/2000 |
| WO | 2010/138522 A2 | 12/2010 |
| WO | 2015/016124 A1 | 2/2015 |
| WO | 2016100871 A1 | 6/2016 |
| WO | 2018/136082 A1 | 7/2018 |

OTHER PUBLICATIONS

Devos et al., Proteins: Structure, Function and Genetics, 2000, vol. 41: 98-107.*
Whisstock et al., Quarterly Reviews of Biophysics 2003, vol. 36 (3): 307-340.*
Witkowski et al., Biochemistry 38:11643-11650, 1999.*
Kisselev L., Structure, 2002, vol. 10: 8-9.*
Naz et al., Rej Research 2013, 16(5), pp. 1-12. (Year: 2013).*
Mutsumura et al. JMB 2001,305, pp. 331-339. (Year: 2001).*
Sakurama, H. et al., "beta—Glucuronidase from Lactobacillus brevis useful for baicalin hydrolysis belongs to glycoside hydrolase family 30," Appl Microbiol Biotechnol., vol. 98:4021-4032 (2014).
Sanchez, P. et al., "Fetal exposure to arsenic results in hyperglycemia, hypercholesterolemia, and nonalcoholic fatty liver disease in adult mice," J. Anal. Toxicol., vol. 36:162 (2014).

(Continued)

*Primary Examiner* — Robert B Mondesi
*Assistant Examiner* — Mohammad Y Meah
(74) *Attorney, Agent, or Firm* — Nelson Mullins Riley & Scarborough LLP; Jill Gorny Sloper, Esq.

(57) ABSTRACT

Chimeric and other variant β-glucuronidase enzymes with enhanced properties as compared to unmodified enzyme are provided. The enzymes of the invention advantageously exhibit enhanced enzymatic activity, enhanced substrate range, enhanced pH range, enhanced temperature range and/or enhanced enzyme stability. Methods of using the variant enzymes for hydrolysis of glucuronide substrates, including opiates and benzodiazepines, are also provided.

16 Claims, 45 Drawing Sheets

Specification includes a Sequence Listing.

(56) References Cited

OTHER PUBLICATIONS

Sitasuwan, P. et al., "Degradation of Opioids and Opiates During Acid Hydrolysis Leads to Reduced Recovery Compared to Enzymatic Hydrolysis," J. Anal. Toxicol., vol. 40:601 (2016).
Stahl, P. et al., "beta-Glucuronidase of Rat Liver Lysosomes," J. Biol. Chem., vol. 246:5398 (1971).
Steffens, DL et al., "Efficient Site-Directed Saturalion Mutagenesis Using Degenerate Oligonucleotides," J. Biomol. Tech., vol. 18:147-149 (2007).
Sudan, C. et al., "Ubiquitous presence of beta-glucuronidase (GUS) in plants and its regulation in some model plants," Planta, vol. 224:853 (2006).
Ulrich, A. et al., "Exponential megapriming PCR (EMP) cloning-seamless DNA insertion into any target plasmid without sequence constraints.," PLoS ONE, vol. 7:e53360 (2012).
Wallace, B. et al., "Alleviating Cancer Drug Toxicity by Inhibiting a Bacterial Enzyme," Science, vol. 330:831 (2010).
Wallace, B. et al., "Structure and Inhibition of Microbiome beta-Glucuronidases Essential to the Alleviation of Cancer Drug Toxicity," Chem. Biol. , vol. 22(9):1238-1249 (2015).
Wang et al., "Incomplete Recovery of Prescription Opioids in Urine using Enzymatic Hydrolysis of Glucuronide Metabolites," J. Anal. Toxicol., vol. 30:570 (2006).
Wang, C. et al., "Studies of Catalysis by beta-Glucuronidase," J. Biol. Chem., vol. 247:2644 (1972).
Waterhouse, A. et al., "Swiss-Model: homology modelling of protein structures and complexes," Nucleic Acids Res., vol. 46(W1):W296-W303 (2018).
Wierenga, R.K. et al., "The TIM barrel fold: a versatile framework for efficient enzymes," FEBS Letters, vol. 492:193-198 (2001).
Xiong, A.S. et al., "Directed evolution of a beta-galactosidase from Pyrococcus woesei resulting in increased thermostable beta-glucuronidase activity," Appl Microbiol Biotechnoly, vol. 77(3), pp. 569-578 (2007).
Xiong, A., et al. "Concurrent mutations in six amino acids in beta-glucuronidase improve its thermostability," Protein Engineering, Design & Selection, vol. 20(7) pp. 319-325 (2007).
Yang, HS et al., "Development and Validation of a Novel LC-MS/MS Opioid Confirmation Assay: Evaluation of beta-glucuronidase Enzymes and Sample Cleanup Methods," J. Anal. Toxicol., vol. 40:323 (2016).
Yeom, S.J. et al., "Controlled Aggregation and Increased Stability of beta-Glucuronidase by Cellulose Binding Domain Fusion.," PLoS ONE, vol. 12:e0170398 (2017).
Meh S et al., "Expression and Purification of Escherichia coli beta-Glucuronidase," Protein Expression and Purification, vol. 22 (1), pp. 75-81 (2001).
Benkert et al., "Toward the estimation of the absolute quality of individual protein structure models," Bioinformatics, vol. 27:343-350 (2011).
Bertoni, M. et al., "Modeling protein quaternary structure of homo- and hetero-oligomers beyond binary interactions by homology," Sci. Reports, vol. 7: 10480: 15 pages (2017).
Bienert, S. et al., "The Swiss-Model Repository-new features and functionality," Nucleic Acid Res. vol. 45:D313-D319 (2017).
Buichett, G. et al., "Native Electrophoresis-Coupled Activity Assays Reveal Catalytically-Active Protein Aggregates of *Escherichia coli* beta-Glucuronidase," PLoS ONE, vol. 10(6): e0130269 (2015).
Callanan, M.J. et al., "Modification of Lactobacillus beta-glucuronidase activity by random mutagenesis," Gene, vol. 389, pp. 122-127 (2007).
Chen, C. et al.," Ecstasy, an adjustable membrane-tethered/soluble protein expression system for the directed evolution of mammalian proteins," Protein Engineering, Design & Selection, vol. 25(7), pp. 367-375 (2012).
Chen, G. J. et al., "Restriction Site-Free Insertion of PCR Products Directionally into Vectors," BioTechniques, vol. 28:498-500 (2000).
Chronopoulou, E. et al., "Site saturation Mutagenesis: A Powerful Tool for Structure Based Design of Combinatorial Mutation Libraries," Curr. Protocols Protein Sci., vol. 63:26.6.1-26.6.10 (2011).
Cummings, O. et al., "Impact of beta-Glucuronidase Mediated Hydrolysis on Haldol® Urinalysis," J. Anal. Toxicol., vol. 42:214 (2018).
Davies, G. et al., "Structures and mechanisms of glycosyl hydrolases," Structure, vol. 3:853 (1995).
Feng, X. et al., "Enhancing the Thermostability of beta-Glucuronidase by Rationally Redesigning the Catalytic Domain Based on Sequence Alignment Strategy," Ind. Eng. Chem. Res., vol. 55:5474-5483 (2016).
Flores, H. et al., "Increasing the thermal stability of an oligomeric protein, beta-glucuronidase.," J. Mol. Biol., vol. 315, Isssue 3, pp. 325-337 (2002).
Folz. R.-J. et al., "Substrate specificity of eukaryotic signal peptidase. Site-saturation mutagenesis at position-1 regulates cleavage between multiple sites in human pre (delta pro) apolipoprotein A-ll.," J. Biol. Chem., vol. 263:2070-2078 (1988).
Fukao, M. et al., "Genomic Analysis by Deep Sequencing of the Probiotic Lactobacillus brevis KB290 Harboring Nine Plasmids Reveals Genomic Stability," PLoS One 8(3): e60521. doi:10.1371/journal.pone.0060521 (2013).
Geddie, M. et al., "Rapid Evolution of beta-Glucuronidase Specificity by Saturation Mutagenesis of an Active Site Loop," The Journal of Biological Chemistry, vol. 279(25) pp. 26462-26468 (2004).
GenBank Accession No. WP 015255760.1, published May 28, 2013.
Genseq Accession No. AAW93825, published Jun. 15, 2007.
Graef, V. et al., "Hydrolysis of steroid glucuronides with beta-glucuronidase preparations from bovine liver, *Helix pomatia*, and *E. coli*," Clin. Chem., vol. 23:532 (1977).
Guex, N. et al., "Automated comparative protein structure modeling with Swiss Model and SwissPdbViewer: A historical perspective," Electrophoresis, vol. 30:S162-S173 (2009).
Hassan, I. et al., "High resolution crystal structure of human beta-glucuronidase reveals structural basis of lysosome targeting," PLoS One 8:e79687 (2013).
Hernandez et al., "Control of protein immobilization: Coupling immobilization and site-directed mutagenesis to improve biocatalyst or biosensor performance," Enzyme and Microbial Technology, vol. 48:107-122 (2011).
Hochuli, E. et al., "Genetic Approach to Facilitate Purification of Recombinant Proteins with a Novel Metal Chelate Adsorbent," Nature Biotech., vol. 6:1321-1325 (1988).
International Preliminary Report on Patentability, PCT/US2017/014387, dated Jul. 23, 2019, 6 pages.
International Search Report and Written Opinion, PCT/US2017/014387, dated Apr. 19, 2017, 10 pages.
Jain, S. et al., "Structure of human beta-glucuronidase reveals candidate lysosomal targeting and active-site motifs," Nature Struct. Biol., vol. 3:375 (1996).
Joshi, M. et al., "Dissecting the Electrostatic Interactions and pH-Dependent Activity of a Family 11 Glycosidase†,‡," Biochemistry 40:10115 (2001).
Kim H.S. et al., "Cloning and expression of beta-glucuronidase from Lactobacillus brevis in *E. coli* and application in the bioconversion of baicalin and wogonoside," J Microbiol Biotechnol., vol. 19(12), pp. 1650-1655 (2009).
Kotronoulas, A. et al., "Evaluation of two glucuronides resistant to enzymatic hydrolysis as markers of testosterone oral administration," J. Steroid Biochem. Mol. Biol., vol. 167B:212 (2017).
Kuiper, H.A., et al., "Illegal use of beta-adrenergic agonists: European Community," J. Animal Sci., vol. 76:195-207 (1998).
Lin, Z. et al., "Evaluation of Analytical Procedures for Urinary Codeine and Morphine Measurements," J. Anal. Toxicol. 18:129-133 (1994).
Lv, B. et al., "Structure-guided engineering of the substrate specificity of a fungal beta-glucuronidase toward triterpenoid saponins," J. Biol. Chem., vol. 293(2):433-443 (2018).
Masuo, Y. et al., "Characterization of Inhibitory Effect of Carbapenem Antibiotics on the Deconjugation of Valproic Acid Glucuronide," Drug Metab. Disp., vol. 38:1828 (2010).

(56) References Cited

OTHER PUBLICATIONS

Matsumura, I. et al., "Directed evolution of the surface chemistry of the reporter enzyme beta-glucuronidase," Nat. Biotechnol., vol. 17(7), pp. 696-701 (1999).
Matsumura, I., et al., "In vitro evolution of beta-glucuronidase into a beta-galactosidase proceeds through non-specific intermediates," J. Mol. Biol. vol. 305(2), pp. 331-339 (2001).
McIntosh, L. et al., "The pKa of the General Acid/Base Carboxyl Group of a Glycosidase Cycles during Catalysis:beta-A 13C-NMR Study of Bacillus cilculans Xylanase†," Biochemistry, vol. 35:9958 (1996).
Morris, A. et al., "Opioid Hydrolysis by a Novel Recombinant Beta-Glucuronidase for Urinalysis," Ameritox Medication Monitoring Solutions, Poster Presentation, 2014, Society of Forensic Toxicologists Annual Meeting, held in Grand Rapids, Michigan, Oct. 19-24, 2014, 1 page.
Morris, A.A. et al., "Rapid Enzymatic Hydrolysis Using A Novel Recombinant beta-Glucuronidase in Benzodiazepine Urinalysis," Journal of Analytical Toxicology, vol. 38, pp. 610-614 (2014).
Morris, A.A. et al., "Rapid Enzyme Hydrolysis Using a Novel Recombinant beta-Glucuronidase in Benzodiazepine Urinalysis," Ameritox Medication Monitoring Solutions, Poster Presentation, 2014, American Association of Clinical Chemistry Annual Meeting in Chicago, Illinois, Jul. 30, 2014, 1 page.
Morris, A.A. et al., Buprenorphine Hydrolysis Using a Novel Recombinant Beta-glucuronidase for Urine Drug Testing, Ameritox Medication Monitoring Solutions, Poster Presentation, 2014, Society of Forensic Toxicologists Annual Meeting, held in Grand Rapids, Michigan, Oct. 19-24, 2014, 1 page.
Nakamura, T. et al., "Possible Evidence of Contamination by Catechins in Deconjugation Enzymes from Helix pomatia and Abalone entrails," Biosci. Biotechnol. Biochem., vol. 75:1506 (2011).
Ngo et al. in The Protein Folding Problem and Tertiary Structure Prediction, 1994, Merz et al. (ed.), Birkhauser, Boston, MA, pp. 433 and 492-495.
Pellock, S. et al., "Gut Microbial beta-Glucuronidase Inhibition via Catalytic Cycle Interception," ACS Cenlral Science, vol. 4: 868-879 (2018).
PIR Accession No. A25047, published Jun. 30, 1988.
PIR Accession No. A72300, published Jun. 11, 1999.
Pollet, R. et al., "An Atlas of beta—Glucuronidases in the Human Intestinal Microbiome," Structure, vol. 25:967 (2017).
Rana, S. et al., "A New Method for Simultaneous Determination of Cyclic Antidepressants and their Metabolites in Urine Using Enzymatic Hydrolysis and Fast GC-MS," J. Anal. Toxicol., vol. 32:355 (2008).
Roberts, A. et al., "Molecular Insights into Microbial beta-Glucuronidase Inhibition to Abrogate CPT-11 Toxicity," Mol. Pharmacol. 84:208 (2013).
Romberg, R.W et al., Comparison of the Hydrolysis Rates of Morphine-3-Glucuronide and Morphine-6-Glucuronide with Acid and beta-Glucuronidase, J. Anal. Toxicol., vol. 19:157 (1995).
Russell W.M., et al., "Identification and cloning of gusA, Encoding a New Beta-Glucuronidase from Lactobacillus Gasseri ADH," Applied and Environmental Microbiology, vol. 67(3), pp. 1253-1261 (2001).
U.S. Appl. No. 15/076,134, filed Mar. 21, 2016, Lim Andrew Lee.
U.S. Appl. No. 14/867,710, filed Sep. 28, 2015, Lim Andrew Lee.
U.S. Appl. No. 15/076,183, filed Mar. 21, 2016, Jia Yang.
U.S. Appl. No. 16/478,674, filed Jul. 17, 2019, Lim Andrew Lee.
U.S. Appl. No. 16/528,292, filed Jul. 31, 2019, Lim Andrew Lee.
U.S. Appl. No. 15/076,134, Apr. 3, 2017.
U.S. Appl. No. 15/076,134, Dec. 2, 2016.
U.S. Appl. No. 15/076,134, Jul. 27, 2016.
U.S. Appl. No. 14/867,710, Oct. 30, 2017.
U.S. Appl. No. 14/867,710, Aug. 16, 2017.
U.S. Appl. No. 14/867,710, Jan. 12, 2017.
U.S. Appl. No. 14/867,710, Jul. 27, 2016.
U.S. Appl. No. 15/067,183, Oct. 24, 2017.
U.S. Appl. No. 15/076,183, Jun. 7, 2017.
U.S. Appl. No. 15/076,183, Mar. 24, 2017.
Accession C4Z6Z2. Jul. 28, 2009 (Year: 2009).
Accession K0JGG2. Nov. 28, 2012 (Year: 2012).
Chica, R. et al., "Semi-rational approaches to engineering enzyme activity: combining the benefits of directed evolution and rational design," Curr Opin Biotechnol., vol. 16(4):378-384 (2005).
Singh, R. et al., "Protein Engineering Approaches in the Post-Genomic Era," Curr Protein Pept Sci., vol. 18: 1-11 (2017).
Zhang, X. et al., "Increased activity of β-glucuronidase variants produced by site-directed mutagenesis," Enzyme and Microbial Technology, vol. 109:20-24 (2018).
U.S. Appl. No. 16/478,674, Jun. 11, 2021.
Liu, M. et al., "Improving the activity and thermostability of GH2 beta-glucuronidases via domain reassembly," Biotechnol Bioeng., 1-11 (2021).
Schlachter, C. et al., "Variants of glycosyl hydrolase family 2 beta-glucuronidases have increased activity on recalcitrant substrates," Enzyme and Microbial Technology, vol. 145 (109742): 11 pages (2021).
U.S. Appl. No. 17/547,854, filed Dec. 10, 2021, John Tomashek.

\* cited by examiner

```
EeGUS    ------------------------MLYPVLTQSRL-LSDLSGVWDFKLDNG--------      26
AoGUS    ------------------------MLKPQQTTTRD-LISLDGLWKFALAS--------      25
Rxn3     ------------------------MLKPQQTTTRD-LISLDGLWKFALAS--------      25
AtGUS    ------------------------MLKPRQTPFRD-LISLDGLWKFALDSG-------      26
EcE1F    ------------------------MLRPVETPTRE-IKKLDGLWAFSLDREN------      27
BpGUS    --------------------MVNSMLYPRESRTRR-VVDISGMWEFKIDIN-------      30
BmGUS    --------------------MVNSMLYPRESRTRR-VVDISGMWEFKIDSN-------      30
CpGUS    ------------------------MLYPIITESRQ-LIDLSGIWKFKLNEG-------      26
StpGUS   ------------------------MLYPINTETRG-VFDLNGVWNFKLDYG-------      26
LbLR2D   ------------------------MLYPMETASRV-VLDLSGVWRFMIDKE-------      26
SaGUS    ------------------------MLYPLLTKTRN-TYDLGGIWNFKLG---------      24
HsGUS    MARGSAVAWAALGPLLWGCALGLQGGMLYPQESPSRE-CKELDGLWSFRADFSDN----      54
BfGUS    -MKKLLAAAMLFMLNSWSCFSADTPRAEYPRPQFEREQWVNLNGTWTFDFDFGK----      53
PmGUS    -MKRISIAFLSLFLCVASVWSMPRP---EYPRPQFERAGWVNLNGEWTCSFDFGG---      51
BuGUS    ---MKTLLKNSLTFLLMLMPVLAFAQQAPQIMNVSARQTTSLDGQWKTIVDPFENGYYDY   57
                                 .::  *  *

EeGUS    ----------KGFEEKWYEKPLKD----ADTMPVPASYNDLKEGTDFRDHYGWVEYQRNI  72
AoGUS    ----------DDNNTQPWTSQLKT---SLECPVPASYNDIFADSKIHDHVGWVYYQRDV  71
Rxn3     ----------DDNNTQPWTSQLKT---SLECPVPASYNDIFADSKIHDHVGWVYYQRDV  71
AtGUS    ----------DNATAAPWTGPLTT---DLECPVPASYNDIFVDRQIRDHVGWVYYQREA  72
EcE1F    ----------CGIDQRWWESALQE---SRAIAVPGSFNDQFADADIRNYAGNVWYQREV  73
BpGUS    ----------NEGRNSGYANGLKD----TTFIPVPSSFNDLFTDKNIREHAGDVWYETSF  76
BmGUS    ----------NEGRKNGYANGLKD----TTFIPVPSSFNDLFTDKNIREHAGDIWYETSF  76
CpGUS    ----------NGLTEELSKAPLED----TIEMAVPSSYNDLVESQEVRDHVGWVWYERNF  72
StpGUS   ----------KGLEEKWYESKLTD---TISMAVPSSYNDIGVTKEIRNHIGYVWYEREF  72
LbLR2D   ----------Q--IPVDVTRPLPA---TLSMAVPASFNDQTASKEIREHVGYVWYERCF  70
SaGUS    ----------EHNPNELLPS-------DEVMVIPTSFNDLMVSKEKRDYIGDFWYEKVI  66
HsGUS    --------RRRGFEEQWYRRPLWESGPTVDMPVPSSFNDISQDWRLRHFVGWVWYEREV  105
BfGUS    ----------SGKDRRLQSAEKFD---KNITVPFCPESKLSGVGYTDFIEQMWYQRNI  98
PmGUS    ----------SGMEREFYKSKGFD---KKITVPFCPESKLSGIGYTDFINHFWYQRPI  96
BuGUS    RLKPYDGGYAQDKTYSDKTKLQEYDFETDKLLFVPGDWN--TQRPQLYYYEGTVWYRKHF  115
                              :*    :         :   ..:..*.

EeGUS    SVPEYVKS----QRIVLRCAAVTHYAMIYLNGKLICEHKGGFLPFEVELNDDLQDGD----  125
AoGUS    IVPKGWSE----ERYLVRCEAATHHGRIYVNGNLVADHVGGYTPFEADITDLVAAGEQ---  125
Rxn3     IVPKGWSE----ERYLVRCEAATHHGRIYVNGNLVADHVGGYTPFEADITDLVAAGEQ---  125
AtGUS    IVPRAWSQ----QQYLVRVDAATHQGRIYINDNLVAEHRGGYTPFEADITGLVSAGDS---  126
EcE1F    FIPKGWAG----QRIVLRFDAVTHYGKVWVNNQEVMEHQGGYTPFEADVTPYVIAGKS---  127
BpGUS    YLPLEWKD----KDVNRFGCATHEATVYINGKEVCTHVGGFMPFNAPVNEAGIFGEK---  130
BmGUS    YLPLEWKD----KNVNIRFGCATHEAAVYINGKEVCTHVGGFMPFNAPVNEAGIFGEK---  130
CpGUS    TIPKTLLN----ERIVLRFGSATHEAKVYLNGELLVEHKGGFTPFEAEINDLLVSGD----  125
StpGUS   TVPAYLKD----QRIVLRFGSATHKAIVYVNGELVVEHKGGFLPFEAEINNSLRDGM----  125
LbLR2D   ELPQLLRQ----ERLVLRFGSATHEAWVYLNGHLITHHKGGFTPFEVEINDDLVTGE----  123
SaGUS    EVPKVSEG----EEMVLRFGSVTHQAKIYVDGILVGEHKGGFTPFEVLVPECKYNNEK---  120
HsGUS    ILPERWTQDLRTRVVLRIGSAHSYAIVWVNGVDTLEHEGGYLPFEADISNLVQVGPLPSR  165
BfGUS    TIPSDWNG----KKIFLNFGAVDYCAEIYDGKFVQRHFGSSSFAVDLTRYVIPGKT----  152
PmGUS    TIPQEWNG----KNILLNFGAVYYKSEVYIDGVLASRHFGGTSSFAVDITSLVKPGQT---  150
BuGUS    EYSLQPGK----RLFLNFGAVNYEAIVWLNGKRLGRHIGGFTPFNFEITNLLKEGTN---  168
                      ::  ..  .:::: *  **    *  :           .  .
```

FIG. 1

```
EeGUS  NLLTIAVNNVIDYTTLPVGGKANMMSGMMGGMGAGASDKPQNNPNFDFFNYCGITRPVKI  185
AoGUS  FRLTIAVDNELTYQTIPPGK------------VEILEATGKKVQTYCHDFYNYAGLARSVWL  175
Rxn3   FRLTIAVDNELTYQTIPPGK------------VEILEATGKKVQTYCHDFYNYAGLARSVWL  175
AtGUS  FRLTIAVNNELTHETIPPGR------------IEVEEYTGKRVQVYCHDFFNYAGLARSVWL  176
EcE1F  VRITVCVNNELNWQTIPPG-------------MVITDENGKKKQSYFHDFFNYAGIHRSVML  176
BpGUS  NKLVVVVNNELSNTTIPCG-------------HTETKPSGKKYIKPSFDFFNYAGLNRPVKI  179
BmGUS  NKLVVVVNNELSNTTLPCG-------------HTETKPSGKKYIKPSFDFFNYAGLNRPVKI  179
CpGUS  NRLTVAVNNIIDETTLPVG-------------LVKEVEVDGK-KVIKNSVNFDFFNYAGIHRPVKI  177
StpGUS NRVTVAVDNILDDSTLPVG-------------LYSERHEEGLGKVIRNKPNFDFFNYAGLHRPVKI  178
LbLR2D NRLTVKLSNMLDYTTLPVG-------------HYKETQNETGQRVRQLDENFDFFNYAGLQRPVKI  176
SaGUS  IKVSICANNVLDYTTLPVG-------------NYSELIQEDGSIKKKVRENFDFFNYAGVHRPLKL  173
HsGUS  LRITIAINNTLTPTTLPPGT------------IQYLTDTSKYPKGYFVQNTYFDFFNYAGLQRSVLL  220
BfGUS  HNLVVFVQDDLRSGLQTGGK------------------QCGNYYSGGCSYTRTTGIWQTVWM  196
PmGUS  HSLVVYVESDVRGAKQAAGK------------------QNLQYASYGCNYIRTTGIWQTVWM  194
BuGUS  -SLVVKVDNKRLPEAVPTVN------------------ADWWNFGGITRPVTL  202
       :  :  ..         .:  .  * :.:.  :

EeGUS  YTTPETYINDITVTADIDFTKEEPSAVLNYNVEIKGKDYNNITCKVELFDEEGTKLSETE  245
AoGUS  YSVPQQHIQDITVRTDVQG------TTGLIDYNVVAS-TTQGTIQVAVIDEDGTTVATSS  228
Rxn3   YSVPQQHIQDITVRTDVQG------TTGLIDYNVVAS-TTQGTIQVAVIDEDGTTVATSS  228
AtGUS  YSVPQQHIQDIKVVTHVKG------SAGLINYLVTVSNSTTGRVKIDVIDKDGTTVAEAS  230
EcE1F  YTTPNTWVDDITVVTHVAQD-----CNHASVDWQVVAN----GDVSVELRDADQQVVATGQ  228
BpGUS  TVTNKEYIHDIDILSDVNGS-----DGIVNYEVHTTGENK----VYIKINDEEGKEVASCE  231
BmGUS  TVTNKEYIYDIDILSDINGS-----DGIVNYEVHTTGENK----VFVKIYDEEGKEAASAE  231
CpGUS  YTTPKSYIEDITIVTDFKEN-----NGYVNYEVQAVGKCN----IKVTIIDEENNIVAEGE  229
StpGUS YTTPFTYVEDISVVTDFNGP-----TGTVTYTVDFQGKAET---VKVSVVDEEGKVVASTE  231
LbLR2D YSTPHSYIRDITLTPKVNLT--NHSAVVNGEIETVGDVEQ---VVVTILDEDNQVVGTTS  231
SaGUS  MIRPKNHISDITITSRLSDD--LQSADLHFLVETNQKVDE---VRISVFDEDNKLVGETK  228
HsGUS  YTTPTTYIDDITVTTSVEQD-----SGLVNYQISVKGSNLFKLEVRLLDAENKVVANGT  274
BfGUS  EAVSADGLKSVFVRPDIDQK-----QLVIEPEFYNESANTLEITLKDRNKTVAKKSVNCAN  252
PmGUS  EAVHPEGLQSIQLLTDIDQQ-----QLVVRPRFYKEAGGKLQVTLKDNGKVVASRTVSASS  250
BuGUS  IEMPATYIRDYYVQLAKDDK-----NMIEGWVQLEGSDKEQKITLDIPELKVKKEVTTDAN  258
       :  :

EeGUS  GSEGTFEISNVRLWQP-----LNAYLYKIKVTAG----------ODVYTLPYGVRSVRVDGT  292
AoGUS  GSNGTIHIPSVHLWQP-----GAAYLQLHASIIDS--SKKTIDTYKLATGIRTVKVQGT  281
Rxn3   GSNGTIHIPSVHLWQP-----GAAYLQLHASIIDS--SKKTIDTYKLATGIRTVKVQGT  281
AtGUS  GARGSVTIDSVKLWQP-----GEAYLQFRASIVGL--NDSVVDTYCVETGVRTVKVSGN  283
EcE1F  GTSGTLQVVNPHLWQP-----GEGYLYELCVTAKS---QTECDIYPLRVGIRSVAVKGE  279
BpGUS  GKSGKIVIKDAKLWNP-----KAAYLYKFIACIKN----GDELIDEYYLDFGIRTVKVEGT  283
BmGUS  GKNGKIVIKNAKLWNP-----KAAYLYKFEACIKN----GEELIDEYYLDFGIRTIKVEGT  283
CpGUS  GKEGKLTINNVHLWEP-----MNAYLYKLKVELLD----DEEIIDTYFEEFGVRTVEVKDG  281
StpGUS GLSGNVEIPNVILWEP-----LNTYLYQIKVELVN----DGLTIDVYEEPFGVRTVEVNDG  283
LbLR2D GKTLAIELNSVHLWQP-----GKAYLYRAKVELYQ----AGQVIDTYIETFGIRQIAVKAG  283
SaGUS  --DSRLFLSDVHLWEV-----LNAYLYTARVEIFV----DNQLQDVYEENFGLREIEVTNG  278
HsGUS  GTQGQLKVPGVSLWWPYLMHERPAYLYSLEVQLTAQTSLGPVSDFYTLPVGIRTVAVTKS  334
BfGUS  SSVVVLPVKNMKLWSP-----EDPFLYDLVYQVKDA--KGNVLDEVKSYAGMRKVHTANG  305
PmGUS  LSSVVLPVKKMKTWSP-----ESPFLYDLEYKVLDK--NGNIIDEVNGYAGMRKVHIEGN  303
BuGUS  GYASFLIKSKPILWTP-----ENPKLYAVNLASET---------DKVSDEIGFRTIRTEGI  305
       .        *         **        *             *   *.*   :
```

FIG. 1 (cont'd.)

```
EeGUS    KFLINEKPFYEKGYGKH-EDTFPNGRGINLPMNTKDISIMKWQHANSFRTSHYPYSEEMM  351
AoGUS    QFLINDKPFYETGFGKH-EDTNIRGKGHDDAYMVHDFQLLHWMGANSFRTSHYPYAEEVM  340
Rxn3     QFLINDKPFYETGFGKH-EDSAVRGKGYDPAYMVHDFQLMDWMGANSFRTSHYPYAEEVM  340
AtGUS    KFLINDKPFYETGFGKH-EDSAVRGKGYDPAYMVHDFQLMDWMGANSFRTSHYPYAEEVM  342
EcE1F    QFLINHKPFYETGFGRH-EDADLRGKGFDNVLMVHDHALMDWIGANSYRTSHYPYAEEML  338
BpGUS    KFLINGKPFYETGFGKH-EDSEIAGRGYNPPVIKRDFELIKWGANSFRTSHYPYSEEIM   342
BmGUS    KFLINGKPFYETGFGKH-EDSETAGRGYNPPVIKRDFELIKWIGANSFRTSHYPYSEEIM  342
CpGUS    KFLINNKPFYETGFGKH-EDSYVNGRGINEAINIKDFNLMKWIGANSFRTSHYPYSEEIM  340
StpGUS   KFLINNKPFYETGFGKH-EDTPINGRGFNEASNVMDFNILKWIGANSFRTAHYPYSEELM  342
LbLR2D   KFLINGQPFYETGFGKH-EDAYIHGRGLSEPQNVLDLSLMKQMGANSFRTSHYPYSEEMM  342
SaGUS    QFLINDKPFYETGFGKH-EDTFINGRGLNEAANLMDINLLKDIGANSFRTSHYPYSEEMM  342
HsGUS    QFLINGKPFYETGVNKH-EDADIRGKGFDWPLLVKDFNLRWLGANAFRTSHYPYAEEVM  393
BfGUS    RFYLNNQPYIEQRLVLDQGFYPEGIWTAPSDEDLKNDIVIGKEAGFNGARLHQKVFEERYY 365
PmGUS    KIYLNNKPYYEQRLVLDQGFYPDGIWTAPSDEALKRDIELSMEAGFNGARLHQKVFEERFY 363
BuGUS    KILLNDKEIFCRGISIHEETPYYSGRAYSKDHAHTLLSWAKELGCNFVRLAHYPHNEEMV   365
         : :  :*:           :                          *  *   *    *.

Variant
                                                                        Site 1

EeGUS    RLCDEEGIVVIDETTAVGVNLQFGGGANFGGERIGTFDKEHG-VQTQEHHKDVIRDLISR  410
AoGUS    EYADRQGIVVIDETPAVGLAFSIGAGAQTSNPP-ATFSPDRINNKTREAHAQAIRELIHR  399
Rxn3     EFADRHGIVVIDETPAVGLAFSIGSGVSSEDSP-QTFTPEGINNNTREAHKQAIRELIAR  399
AtGUS    EFADRHGIVVIDETPAVGLAFSIGSGVSSEDSP-QTFTPEGINNNTREAHKQAIRELIAR  401
EcE1F    DWADEHGIVVIDETAAVGFNLSLGIGFEAGNKPKELYSEEAVNGETQQAHLQAIKELIAR  398
BpGUS    QAADREGIVIIDEVAAVGMFDVGSVLNPSASKTDYFSLDEVH-SKTKEVHKKAVEELIKR  401
BmGUS    QAADREGIVIIDEIAAVGMFDVGSVLNPGASKADYFSLEEVH-TKTKEIHKKAVEELITR  401
CpGUS    RLADREGIVWIDETPAVGLHLNFMATG-FGGDAP-KRDTWKE-IGTKEAHERILRELVSR  397
StpGUS   RLADREGIVVIDETPAVGVHLNFMATTGLGEGSE-RVSTWEK-IRTFEHHQDVLRELVSR  400
LbLR2D   RLCDREGIVVIDEVPAVGIMLSFTFDVSALEKDDFEDDIWEK-LRTAEAHRQAITEMIDR  401
SaGUS    RLADRMGVLVIDEVPAVGLFQNFNASLDLSPKD---NGTWSL-MQTKAAHEQAIQELVKR  393
HsGUS    QMCDRYGIVWIDECPGVGLALPQFFNN--------------VSLHHHMQVMEEVVRR    436
BfGUS    YWADKLGYITWGESASWMLDVNK----------------------ELAARNFLGEWSEVVVR  405
PmGUS    YWADKMGYLTWGEASSWGMDCND----------------------TETARNFITEWSEIVQR  403
BuGUS    REAERMGFLVWSEIPVYWTIHWEN----------------------KDTYQNAEQQLCDMIAR  406
         .: :  * :  *:*                                :   ::: :

EeGUS    DKNHACVVMWSIANEPDSAAEGAYDYFKPLYDLARELDPQKRPCTLVS----VQGTTADT  466
AoGUS    DKNHPSVVMWSIANEPASNEDGAREYFAPLPKLARQLDPT-RPVTFAN----VGLATYKA  454
Rxn3     DKNHASVVMWSIANEPASQEVGAREYFAPLVDLAHELDPS-RPVCFAN----YGDATYEV  454
AtGUS    DKNHASVVMWSIANEPASQEVGAREYFAPLVDLAHELDPS-RPVCFAN----YGDATYEV  456
EcE1F    DKNHPSVVMWSIANEPDTRFQGAREYFAPLAEEATRKLDPT-RPITCVN----VMFCDAHT  457
BpGUS    DKNHPSVVMWSLFNEPDTSKDEAVPYFEDIFNFAKSQDKQNLPKTFAA----IQASSPGK  457
BmGUS    DKNHPSVVMWSLFNEPDTSKDEALPYFEDIFNFAKSIDKQNLPKTFAA----IQASAPGK  457
CpGUS    DKNHPCVVMWSVANEPDSDSEGAKEYFEPLIKLTKELDPQKRPVTVVT----YLMSTPDR  453
StpGUS   DKNHPSVVMWSIANEAATEEEGAYAYEYFKPLVELTKELDPQKRPVTIVL----FVMATPET  456
LbLR2D   DKNHASVVMWSISNEAANFSKGAYEYFKPLFDLARKLDDPQORPCTYTS----IMTTLKT  449
SaGUS    DKNHPSVVMWVVANEPASHEAGAHDYFEPLVKLYKDLDPQKRPVTLVN----ILLATPDR  440
HsGUS    DKNHPAVVMWSVANEPASHLESAGYYLKMVIAHTKSLDPS-RPVTFVS----NSN--YAA 489
BfGUS    DRNHPSLVTWTPPFNETWGGGPDAYIRLVRDVYNITKAIDPTRPVNDASGD--NFMVITDIW  463
PmGUS    DRNHPSLLIWTPTNEEFWPDRVQYPRLMFDLYNLTKMIDPTRPEHGASGG--THITATDIW  461
BuGUS    DKNRCNIIIWSIANETP-HSETRLTFLSNLANKARSLDSVRLIGAAMEKEEVQPGVLTVN  465
         *:*:  ::  *  **       :              :      .

Variant
                                                                        Site 2
                                                                        (M-loop)
```

FIG. 1 (cont'd.)

```
EeGUS    DCSSQLSDVICLNRYYG----------WYFGGPDLEVSEIGLR-KELSDWGKLG--KPVM 513
AoGUS    DRIADLFDVLCLNRYFG----------WYTQTAELDEAEAALE-EELRGWTEKYD-KPIV 502
Rxn3     DRISDMFDVLCLNRYFG----------WYSQTGEVEEAEAALE-KELLGWEGKYG-KPIV 502
AtGUS    DRISDMFDVLCLNRYFG----------WYSQTGEVEEAFAALE-KELLGWEGKYG-KPIV 504
EcE1F    DTISDLFDVLCLNRYYG----------WYVQSGDLETAEKVLE-KELLAWQEKLH-QPII 501
BpGUS    CKCMHLCDVITLNRYYG----------WYFLGG-YEIDMSEEK-FREEMNLYSNMNKPVM 505
BmGUS    CKCMHLCDVITLNRYYG----------WYFLGG-YEIDMSEEK-FREEMNLYKDMNKPVM 505
CpGUS    CKVGDIVDVLCLNRYYG----------WYVAGGDLEEAKRMLE-DELKGWEERCPKTPIM 502
StpGUS   DKVAELIDVIALNRYNG----------WYFDGGDLEAAKVHLR-QEFHAWNKRCPGKPIM 505
LbLR2D   DRCLALADVIALNRYYG----------WYMGNGDLKAAETATR-EELLAYQAKFPDKPIM 506
SaGUS    DQVMDLVDVVCLNRYYG----------WYVDHGDLTNAEVGLR-KELLEWQDKFPDKPII 498
HsGUS    DKGAPYVDVICLNSYYS----------WYHDYGHLELIQLQLA-TQFENWYKKYQ-KPII 537
BfGUS    SVHNYEQDRAKLTEQLK-----------------MEEGKEPYRNARDKDFLAVYEGQPYM 506
PmGUS    TVHNYEQDPAKLKEKLYNGGKLMEAPKWEIHLMPMNIGYNGLKYTDQYAFPEYKKDMPYL 521
BuGUS    DPLGELLDIISFNEYVG----------WYDGDSEKCDR----------VNWTFDTQKPVF 505
                  *          :.                                    *  .

EeGUS    FTEYGADTVSGLHDTTSVMYTEEYQVEYYEMNNKVFD---EDFVVGEQAWNFADFATSQ- 570
AoGUS    MTEYGADTVAGLHSVMVTPWSEEFQVEMLDMYHRVFD---RFEAMAGEQVWNFADFQTAV- 559
Rxn3     ITEYGADTMAGLHSVLALPWSEEFQVQLLDMYHRVFD---RIDSVVGEHVWNFADFQTAV- 559
AtGUS    ITEYGADTMAGLHSVLALPWNSEEFQVQLLDMYHRVFD---RIDSVVGEHVWNFADFQTAV- 561
EcE1F    ITEYGVDTLAGLHSMYTDMWSEEFQCAWLDMYHRVFD---RVSAVVGEQVWNFADFATSQ- 558
BpGUS    FTEYGADTYAGVHKLPSVMWSEEYQCEYYEMNFKVFD---SYDFIVGEQLWNFADFQTTE- 562
BmGUS    FTEYGADTYAGVHKLPSVMWSEEYQCEYYEMNFKVFD---SYDFIIGEQLWNFADFQTTE- 562
CpGUS    FTEYGADTVAGLHDTVPVMFTEEYQVEYYKANHEVMD---KCKNFVGEQWNFADFATSQ- 559
StpGUS   ITEYGADTVAGFHDIDPVMFTEEYQVEYYQANHVVFD---EPENFVGEQAWNFADFATSQ- 562
LbLR2D   YTEYGADTIAGLHSNYDEPFSEEFQEDYYRMCSRVFD---EVTNFVGEQLWNFADFQTKF- 563
SaGUS    ITEYGADTLPGLHSTWNIPYTEEFQCDFYEMSHRVFD---GIPNLVGEQVWNFADFETNL- 555
HsGUS    QSEYGAETIAGFHQDPPLMFTEEYQKSLLEQYHLGLDQKRRKYVVGELIWNFADPMTEQ- 596
BfGUS    VDEFGGIPWMAEK----DRKNSWGYGGMPENAEAFYKRLEGQIDAFIDSP-HVTGFCYT- 560
PmGUS    VDEFGGIKWNPSQQMESAQNTSWGYGEPPRSLEEFYARLEGQVDAVLSLSNDIWGYCYT- 580
BuGUS    ISELQGGALYGRHGSPKERFTEEYQEDLYIRHVNMLK--RIPGLAGTTPWILKDFRSPRR 563
          * *           :         ..

EeGUS    --SLLRVQGNKKGLFTRDRKPKMVAHYFRNRWSTIPEFGYKTK------------ 611
AoGUS    --GVSRVDGNKKGVFTRDRKPKAAAHLLRKRWTNLHNGTAEGSKTFQ-------- 604
Rxn3     --GIIRVDGNKKGVFTRERKPKAAAHTLKTRWSGMLGSDH-------------- 597
AtGUS    --GIIRVDGNKKGVFTRERKPKAAAHTLKTRWSGMLGSDH-------------- 599
EcE1F    --SILRVGGNKKGIFTRDRKPKSAAFLLQKRWTGMNFGEKPQQGSKQGLCGR--- 608
BpGUS    --GIFRVDGNKKGIFTRNRQPKAVAHLIRSRWNKLPLDYKSKR----------- 603
BmGUS    --GIFRVDGNKKGIFTRTRQPKAVAHYIRSRWTKLPLDYKK------------- 601
CpGUS    --IIRVQGNKKGIFTRERKPKMIAHSLRERWTNIPEFGYKK------------- 599
StpGUS   --GIFRVDGNKKGIFTRERKPKLAAHVFRERWTNIPDFGYKN------------ 602
LbLR2D   --GIQRVQGNKKGIFTRAREPKMVVRYLTQRWRNIPDFNYKK----------- 603
SaGUS    --MILRVQGNHKGLFSRNRQPKQVVKEFKKRWMTIPHYHNKKNSVK-------- 598
HsGUS    --SPTRVLGNKKGIFTRQRQPKSAAFLLRERYWKIANETRYPHSVAKSQCLENSLFT 651
BfGUS    --QLTDVEQEKNGIYYYDRTPKLDMKRIKAIFEKIK---------------- 594
PmGUS    --QLTDVEQEQNGIYYYDRTPKFDMKRIHAIFSKTPESK-------------- 617
BuGUS    HVPEIQDDFNRKGLVSDKGQKKKAFFVLQKWYKELTEAYK------------- 603
           ::.*:     *         *    :  :
```

Variant Site 3

FIG. 1 (cont'd.)

```
CpGUS  MLYPIITESRQLIDLSGIWKFKLN-EGNGLTEELSKAPLEDTIEMAVPSSYNDLVESQEV  59
EeGUS  MLYPVLTQSRLLSDISGVWDFKLD-NGKGFEEKWYEKPLKDADTMPVPASYNDLKEGIDF  59
EcGUS  MLRPVETPTREIKKLDGLWAFSLDRENCGIDQRWWESALQESRAIAVPGSFNDQFADADI  60
AoGUS  MLKPQQTTTRDLISLDGLWKFALASDDN--NTQPWTSQLKTSLECPVPASYNDIFADSKI  58
       :* *  : :: ::.::*::*  :*         :   :   :. ::* *:*  .  .

CpGUS  RDHVGWVWYERNFTIPKTLLNERIVLRFGSATHEAKVYLNGELLVEHKGGETPFEAEIND  119
EeGUS  RDHYGNVFYQRNISVPEYVKSQRIVLRCAAVTHYAMIYLNGKLICEHKGGFPLPFEVEIND  119
EcGUS  RNYAGNVWYQREVFIPKGWAGQRIVLRFDAVTHYGKVWVNNQEVMEHQGGYTPFEADVTP  120
AoGUS  HDHVGWVYYQRDVIVPKGWSEERYLVRCEAATHHGRIYVNGNLVADHVGGYTPFEADITD  118
       :: *  * *::::: **. .   *:**  *. *:. :  *  :: :* ** .:**.:.

CpGUS  LLVSGDNR-LTVAVNNIIDETTI PVG---------LVKEVDVGKKVIKNSVNEDF FNYAG  170
EeGUS  DLQDGDNL-LTIAVNNVIDYTTI PVGGKANMMSGMMGGMGAGASDKPQNNPNEDF FNYCG  178     ┌─────────┐
EcGUS  YVIAGKSVRITVCVNNELNWQT PPG---------MVITDENGKKKQSYFHDF FNYAG  169     │ C-Loop  │
AoGUS  LVAAGEQFRLTIAVDNELTYQT PPGK--------VEILEATGKKVQTYQHDF FNYAG  168     └─────────┘
        :  *. :*  .*:* : :    *.*         :      ***   :: *: *** *

CpGUS  IHRPVKIYTTPKSYIEDITIVTDPFKEN----NGYVNYEVQAVGKCN----IKVTIIDEEN  222
EeGUS  ITRPVKIYTTPETYINDITVTADIDFTKEEPSAVLNYNYVEIKGKDYNNITCKVELPDEEG  238
EcGUS  IHRSVMLYTTPNTWVDDITVVTHVAQDCNHASVDWQVVANG--------DVSVELRDADQ  221
AoGUS  LARSVWLIYSVPQQHIQDITVRTDVQGTTGLIDYNVVASTTQG--------TIQVAVIDEDG  221
       : *.*  :::. .  ::*::: .    .     : :  ..            *.:: :.

CpGUS  NIVAEGEGKEGKLTINNVHLWEPMNAYLYKLKVELLDD-EEIIDTYFEEFGVRTVEVKDG  281
EeGUS  TKLSETEGSEGTFEISNVRLWQPLNAYLYKIKVTAG-------QDVYTLPYGVRSVRVDGT  292
EcGUS  QVVATGQGTSGTLQVVNPHLWQPGEGYLYELCVTAKS--QTECDIYPLRVGIRSVAVKGE  279
AoGUS  TTVATSSGSNGTIHIPSVHLWQPGAAYLYQLHASIIDSSKKTIDTYKLATGIRTYKVQGT  281
       .   :. *.  :  : ::.**:*   **:* .          *       * ::  :

CpGUS  KFLINNKPFYFKGFGKHEDSYVNGRGINEAINIKDFNLMKWIGANSFRTSHYPYSEEIMR  341
EeGUS  KFLINEKPFYFKGYGKHEDTFPNGRGINLPMNTKDISIMKWQHANSFRTSHYPYSEEMMR  352
EcGUS  QFLINHKPFYFTGFGRHEDADLRGKGFDNVLMVHDHALMDWIGANSYRTSHYPYAEEMLD  339
AoGUS  QFLINDKPFYFTGFGKHEDTNIRGKGHDDAYMVHDFQLLHWMGANSFRTSHYPYAEEVME  341
       :**** ****** *:.:**:. :*:*.:: :  .*. :: * .***:*******:**::

CpGUS  LADREGIWVIDETPAVGLHL NFMAWG--FGGDA PKRD-TWKEIGTKEAHERILRELVSRD  398
EeGUS  LCDEEGIVVIDETTAVGVNL DFGGGANFGGERI GTFD-KEHGVQTQEHHKDVIRDLISRD  411   ┌────────┐
EcGUS  WADEHGIVVIDETAAVGFNL SLGIGFEAGNKPK ELYSEEAVNGETCQAHLQAIKELIARD  399   │ Loop1  │
AoGUS  YADRQGIVVIDETPAVGLAF SIGAGAQTSNPP- ATFSPDRINNKTREAHAQAIRELIHRD  400   └────────┘
        ..:.**::*** *** .  .:    .*: :           :                :

CpGUS  KNHPCVVMWSVANEPL SDSE GAKEYFEPLIKLTKELDPQKRPVTVVV YIMSTPDRCKVGD  458   ┌────────┐
EeGUS  KNHACVVMWSIANEPL SAAE GAYDYFKPLYDLARELDPQKRPCILVSY AGTADTDCSSO  471   │ Loop2  │
EcGUS  KNHPSVVMWSIANEPD TRPG AREYFAPLAEATRKLDP-TRPITCVNV MCDAHTDTISD  458   ├────────┤
AoGUS  KNHPSVVMWSIANEPA SNED GAREYFAPLPKLARQLDP-TRPVIFAMV CLATYKADRIAD  459   │ Loop2  │
       ***. :****:***                 :  : ***        :   :  .        └────────┘

CpGUS  IVDVLCI NRYYGWYVAG GDLEEAKRMLEDELKGWEERCPKTPIMFTEYGADTVAGLHDTV  518
EeGUS  LSDVICI NRYYGNYFGPDLEVSEIGLRKELSDWGKLG--KPVMFTEYGADTVSGLHDTT  529   ┌────────┐
EcGUS  LFDVLCI NRYYGWYVQS GDLETAEKVLEKELLAWQEKLH-QPIIITEYGVDTLAGLHSMY  517   │ Y-Loop │
AoGUS  LFDVLCI NRYFGWYVTQI AELDEAEAALEEELRGWTEKYD-KPIVMTEYGADTVAGLHSVM  518   └────────┘
       :.***:* **:.*:*. *   :::   :*::*                 ****. **.

CpGUS  PVMFTEEYQVEYYKANHEVMDKCKNFVGEQVWNFADFATSQGIIRVQ NKK IFTRERKP  578
EeGUS  SVMYTEEYQVEYYEMNNKVFDFDFVGEQAWNFADFATSQSLIRVQ NKK GLFTRDRKP  589   ┌──────────┐
EcGUS  TDMWSEEYQCAWLDMYHRVFDRVSAVVGEQVWNFADFATSQGILRVGGNKK GIFTRDRKP  577   │ N-K-Motif│
AoGUS  VTPWSEEFQVEMLDMYHRVFDRFEAMAGEQVWNFADFQTAVGVSRVDQ NKK VFTRDRKP  578   └──────────┘
              :*::*  :      *:   ***:******  :  :: ***  ***  .***:**

CpGUS  KMIAHSLRERWTNIPEFGYKK-----  599
EeGUS  KMVAHYFRNRWSTIPEFGYKTK----  611
EcGUS  KSAAFLLQKRWTGKNFGEKPQQGGKQ  603
AoGUS  KAAAHLLRKRWTNLHNGTAEGSKTFQ  604
       *  *:  :.**.   :*
```

FIG. 2

```
AoGUS   ....MLKPQQTTTRDLISLDGLWKFALAS--DDNNTQPWTSQLKTSLECPVPASYNDIFADSKI   58
AtGUS   ....MLKPRQTPFRDLISLDGLWKFALDSG-DNATAAPWTGPLTTDLECPVPASYNDIFVDRQI  59
EcE1F   ....MLRPVETPTREIKKLDGLWAFSLDRENCGIDQRWWESALQESRAIAVPGSFNDQFADADI   60
        : :** .*:.*:*:******:**:** .    *  :.**:. * **:********:*.*:.:
```
Restriction Site 1

```
AoGUS   HDHVGNVYYQRDVIVPKGWSEERYLVRCEAATHHGRIYVNGNLVADHVGGYTPFEADITD  118
AtGUS   RDHVGNVYYQREAIVPRAWSQQQYLVRVDAATHQGRIYINDNLVAEHRGGYTPFEADITG  118
EcE1F   RNYAGNVWYQREVFIPKGWAGQRIVLRFDAVTHYGKVWVNNQEVMEHQGGYTPFEADVTP  120
        :: .***:**: :.*:.*: :: :** **.**  :: :*:::: :: *********:*
```

```
AoGUS   LVAAGEQFRLTIAVDNELTYQTIPPGKVEILEATGKKVQTYQHDFYNYAGLARSVWLYSV  178
AtGUS   LVSAGDSFRLTIAVNNELTHETIPPGRIEVEEYTGKRVQVYQHDFFNYAGLARSVWLYSV  179
EcE1F   YVIAGKSVRITVCVNNELNWQTIPPGMVITDENGKKKQSYFHDFFNYAGIHRSVMLYTT  179
         *  *..  :**.  :*** :***** :  : ***:.* *:***:****:.***:**..
```

```
AoGUS   PQQHIQDITVRFDVQGTTGLIDYNVVAS-TTQGTIQVAVIDEDGTTVATSSGSNGTIHIP  237
AtGUS   PQQHIQDIKVTHVKGSAGLINYLVTVSNSTTIGRVKIDVIDKDGTTVAEASGARGSVTID  239
EcE1F   PNTWVDDITVVTHVAQDCNHAS--VDWQVVANGDVSVELRDADQQVVATGQGTSGTLQVV  237
        *: :::**.* . : .:.:: *    : .:: . :.:  :* *: *  . *:.*:  :
```

```
AoGUS   SVHLWQPGAAYLYQLHASIIDSSKKTIDTYKLATGIRTVKVQGTQFLINDKPFYFTGFGK  297
AtGUS   SVKLWQPGEAYLYQFRASIVGLNDSVVDTYCVETGVRTVKVSGNRFLINDKPFYFTGFGK  299
EcE1F   NPHLWQPGEGYLYELCVTAKS--QTECDIYPLRVGIRSVAVKGEQFLINHKPFYFTGFGR  295
         ::*****..****  .::  : :  : * :  .*:*:*.: *.:****:********:
```
Restriction Site 2

```
AoGUS   HEDTNIRGKGHDDAYMVHDFQLLHWMGANSFRTSHYPYAEEVMEYADRQGIVVIDETPAV  357
AtGUS   HEDSAVRGKGYDPAYMVHDFQLMDWMGANSFRTSHYPYAEEMLEFADRHGIVVIDETPAV  359
EcE1F   HEDADLRGKGFDNVLMVHDHALMDWIGANSYRTSHYPYAEEMLDWADEHGIVVIDETAAV  355
        ***:  **** * . *****  *::*:****:*********:::::*::********.**
```
Loop 1 Site A

```
AoGUS   GLAFSIGAGAQTSNPP-ATFSPDRINNKTREAHAQAIRELIHRDKNHPSVVMWSIANEPA  416
AtGUS   GLAFSIGSGVSSEDSP-QTFTPEGINNNTREAHKQAIRELIARDKNHASVVMWSIANEPA  418
EcE1F   GFNLSLGIGFEAGNKPKELYSEEAVNGETQQAHLQAIKELIARDKNHPSVVMWSIANEPD  415
        *: **:*.*. ::..    :.: ::*.:*:**  ***:*** ****.************:
```
Loop 1 Site B

```
AoGUS   SNEDGAREYFAPLPKLARQLDPTRPVTFANVGLATYKADRIADLFDVLCINRYFGWYTQT  476
AtGUS   SQEVGAREYFAPLVDLAHELDPSRPVCFANYGDATYEVDRISDMFDVLCINRYFGWYSQT  478
EcE1F   TRPQGAREYFAPLAEATRKLDPTRPITCVNVMFCDAHTDTISDLFDVLCINRYYGWYVQS  475
        :. .*********  :: :***:**:  .*:  .:: *:*:*:*********:*** *:
```

```
AoGUS   AELDEAEAALEEELRGWTEKYDKPIVMTEYGADTVAGLHSVMVTPWSEEFQVEMLDMYHR  536
AtGUS   GEVEEAEAALEKELLGWEGKYGKPIVITEYGADTMAGLHSVLALPWSEEFQVLLDMYHR  538
EcE1F   GDLETAEKVLEKELLAWQEKLHQPIIITEYGVDTLAGLHSMYTDMWSEEYQCAWLDMYHR  535
         :::.**:.**:**: *. * .:**::****.**:*****:   .****:*  :*****
```

```
AoGUS   VFDRFEAMAGEQVWNFADFQTAVGVSRVDGNKKGVFTRDRKPKAAAHLLRKRWTNLHNGT  596
AtGUS   VFDRIDSVVGEHVWNFADFQTAVGIIRVDGNKKGVFTRERKPKAAAHTLKTRWSGNL---  595
EcE1F   VFDRVSAVVGEQVWNFADFATSQSILRVGGNKKGIFTRDRKPKSAAFLLQKRWTGMNFGE  595
        ****. : .**:*******:*: . **.*****:***:****:**  *: **:.:
```

```
AoGUS   AE--GGKTFQ------    604
AtGUS   ----GGDH--------   599
EcE1F   KPQQGDKQGLCGR---  608
             ** 
```

Restriction Site 3    Restriction Site 4

FIG. 3

```
BpGUS  MVNSMLYPRESRTRRVVDISGMWEFKIDINNEGRNSGYANGLKDTTEIPVPSSFNDLFTD  60
EeGUS  ----MLYPVLTQSRLLSDLSGWDFKLDNGKGFEEKWYEKPLKDADTMPVPASYNDLKEG  56
       ****  ..:*  *.**.*.**:*  ,.    *  .***.  .***.*.***

BpGUS  KNIREHAGDVWYETSFYLPLEWKDKDVNVRFGCATHEATVVINGKEVCTHVGGFMPFNAP  120
EeGUS  TDFRDHYGWVFYQRNVISVPEYVKSQRIVLRCAAVTHYAMIYLNGKLICEHKGGFLPFEVE  116
       ..:.**  *  *.*:.  :*     *  .:  .:*   **.*.***.:*   * ***.**.:

BpGUS  VNEAGIFGEKNKLVVWWNNELSNTTIPCG|HTETKPSGKK-----------YIKPSFDFFN  169
EeGUS  LNDDLQDGD-NLLTIAVNNVIDYTTLPVG|KANMMSGMMGGMGAGASDKPQNNPNFDFFN  175
       :*.     *  *  .*    .*    .  .         .:  ***      C-Loop Site BpGUS  YAGINRPVKITVTNKEYIHDIDILSDVNGSD----GIVNYEVHTTGENK----VYIKIND  221
EeGUS  YCGITRPVKIYTTPETYINDITVTADIDFTKEEPSAVLNYNVEIKGKDYNNITCKVELFD  235
       * .** *****  . .* *  .**:.*   .      :*.*    .*:       * :: *

BpGUS  EEGKEVASCEGKSGKIVIKDAKLWNPKAAYLYKFIACIKNGDELIDEYYLDFGIRTVKVE  281
EeGUS  EEGTKLSETEGSEGTFEISNVRLWQPLNAYLYKIKVTAG-----QDVVTLPYGVRSVRVD  290
       ***  .:.  **  .*.    .**:*.  *****.  .         .*.:**.*.*:

BpGUS  GTKFLINGKPFYFTGFGKHEDSEIAGRGYNPPVIKRDFELIKWVGANSFRTSHYPYSEEI  341
EeGUS  GTKFLINEKPFYFKGYGKHEDTFPNGRGINLPMNTKDISIMKWQHANSFRTSHYPYSEEM  350
       ******* ****** *.******..  ***.*   ..:..:**. *************:

BpGUS  MQAADREGIVIIDEVAAVGMFD|VGSVLNPSASKT|DYFSLDEVHSKTKEVHKKAVEELIKR  401  Loop 1 Swap1
EeGUS  MRLCDEEGIVVIDETTAVGVNL|DFGGANFGGERI|GTFDKEHQVQTQEHHKDVIRDLISR  410  Loop 1 Swap2
       *.*  *:*****:**  ***.:      :..:*     * ***.:** .:.:**.

BpGUS  DKNHPSVWMWSLFNEPDTSKDEAVPYFEDIFNFAKSQDKQNLPKTFAAIQASSPGKCKCM  461
EeGUS  DKNHACVWMWSIANEPDSAABGAYDYFKPLYDLARELDPQKRPCTLVSVQGTTADTDCSS  470
       ****  ,.*****:**.**:.**  *  * *:  ..::.:*  *  *:  .*:*:...  ..

BpGUS  HLCDVITLNRYYGWYFLGGYEIDMSEEKFREEMNLYSNMNKPVMFTEYGADTYAGVHKLP  521
EeGUS  QLSDVICLNRYYGWYFGG-PDLEVSEIGLRKELSDWGKLGKPVMFTEYGADTVSGLHDTT  529
       :*.***.********* *   :*.::  **  :..:.***********.:*.***.

BpGUS  SVMWSEEYQCEYYEMNFKVFDSYDFIVGEQLMNFADFQTTEGIFRVDGNKKGIFTRNRQP  581
EeGUS  SVMYTEEYQVEYYEMNNKVFDEFDFVVGEQAMNFADFATSQSLLRVCGNKKGLFTRDRKP  589
       ***:.****.******  ****..***.***** *****.*:.  ..*** **** *.*

BpGUS  KAVAHLIRSRWNKLPLDYKSKK  603
EeGUS  KMVAHYFRNRWSTIPEFGYKTK  611
       * ***  .*.**  :*  .**.*
```

FIG. 4

CHIMERIC AND OTHER VARIANT BETA-GLUCURONIDASE ENZYMES WITH ENHANCED PROPERTIES

CROSS-REFERENCE TO RELATED APPLICATIONS

This application claims the benefit of the filing date under 35 U.S.C. § 119(e) to U.S. Provisional Patent Application No. 62/742,779, filed Oct. 8, 2018, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Oct. 7, 2019, is named IMJ-010_SL.txt and is 729,968 bytes in size.

BACKGROUND OF THE INVENTION

In mammals, glucuronidation via the UDP glucuronyl transferase system is one principle means of detoxifying or inactivating compounds. Compounds are conjugated by the glucuronyl transferase system to form glucuronides, which are then secreted in urine or into the lower intestine in bile. The beta-glucuronidase (BGUS) enzyme catalyzes the hydrolysis of a wide variety of beta-glucuronides. Given the key role of glucuronidation in detoxification of compounds, the BGUS enzyme has been used for detection of drugs in bodily samples, such as to detect the presence of therapeutic drugs in bodily samples of hospital patients. For example, a bodily sample can be tested for the presence of a drug by treating the sample with BGUS and detecting the hydrolysis product of the glucuronide form of the drug. The hydrolysis of the glucuronide by the BGUS enzyme facilitates the analysis of the drug by methods such as mass spectrometry, since this analytical instrument is less sensitive to the glucuronide.

Beta-glucuronidases (BGUS; EC 3.2.1.31) hydrolyze the beta-glycosidic bond between the anomeric reducing end of glucuronic acid (GlcU or gluc) and a broad range of possible aglycones. Enzymes with this activity are found predominantly in glycosyl hydrolase family 2 (GH2), although other examples can also be found in GH30 (Sakurama et al. (2014), *Appl. Microbiol. Biotechnol.* 98: 4021), GH1, GH79 and GH137. All BGUS enzymes characterized thus far are retaining enzymes utilizing a double displacement reaction, with a covalent enzyme-glucuronic acid intermediate, to add water across the glycosidic bond (Wang and Trouser (1972) *J. Biol. Chem.* 247:2644; Davies and Henrissat (1995) *Structure* 3:853). Well characterized examples come from bacteria, particularly *E. coli* gusA (formerly uidA), mammalian species (bovine, mouse, rat, human), where the enzyme normally localizes to lysosomes and defects may contribute to lysosomal storage disorders, and mollusks (snail, abalone, limpet), the source of crude hydrolytic extracts utilized for both research and applications in forensic and clinical medicine (Graef et al. (1977) *Clin. Chem.* 23:532; Romberg and Lee (1995) *J. Anal. Toxicol.* 19:157; Yang et al. (2016) *J. Anal. Toxicol.* 40:323). Additional applications for the preparation of food additives and traditional remedies are under consideration (Kim et al. (2009) *J. Microbiol. Biotechnol.* 19:1650; Sakurama et al. (2014) *Appl. Microbiol. Biotechnol.* 98:4021).

Genes for BGUS, especially gusA, have been favored as reporters in gene regulation studies because of the wide range of substrates with easily detected aglycone products (non-limiting examples of aglycones include p-nitrophenol, phenolphthalein, 4-methylumbelliferone, indigo-blue, fluorescein). This is particularly true for studies in plants, where for many years BGUS activity was believed to be absent. Evidence of naturally occurring BGUS in plants has been discovered, but plant enzymes generally have lower pH optima and growth-specific expression patterns (Sudan et al. (2006) *Planta* 224:853).

As discussed above, one significant application for BGUS enzymes is in clinical and forensic analysis of biological samples for the quantitative measurement of drugs and metabolites. In the body, toxic metabolites and foreign molecules such as drugs are glucuronidated by enzymes in the liver to increase their solubility and tag them for excretion. Thus, a broad range of glucuronidated molecules end up in the urine and other bodily fluids. To identify and quantify these molecules ("target substrates"), the preferred approach is to remove excretion tags such as glucuronic acids (some molecules are sulfated as well) and quantify the free aglycones by separation methods such as liquid chromatography (LC) and gas chromatography (GC), and methods for detection, identification and quantitation such as mass spectrometry (MS). Protocols for de-glucuronidation of excretion products initially favored acid hydrolysis (Romberg and Lee (1995) *J. Anal. Toxicol.* 19:157; Wang et al. (2006) *J. Anal. Toxicol.* 30:570). However, though simple and broadly applicable, acid hydrolysis is slow, messy and harsh, suffering from side reactions that break down some molecules targeted for analysis (Romberg and Lee (1995) *J. Anal. Toxicol.* 19:157; Sitasuwan et al. (2016) *J. Anal. Toxicol.* 40:601). In contrast, enzymatic hydrolysis is specific, potentially fast and can be accomplished under gentle conditions (Rana et al. (2008) *J. Anal. Toxicol.* 32:355; Sanches et al. (2012) *J. Anal. Toxicol.* 36:162; Morris et al. (2014) *J. Anal. Toxicol.* 38:610; Yang et al. (2016) *J. Anal. Toxicol.* 40:323; Cummings et al. (2017) *J. Anal. Toxicol.* 42:214). Thus, enzymatic methods have largely superseded acid hydrolysis.

Although the specificity of BGUS is determined by its ability to recognize glucuronic acid and the anomeric bond (Pollet et al. (2017) *Structure* 25:967), interactions between an aglycone and an enzyme are unique to the aglycone and enzyme pair in question, likely due to steric interactions that are not yet well characterized (Masuo et al. (2010) *Drug Metab. Disp.* 38:1828; Kotronoulas et al. (2016) *J. Steroid Biochem. Mol. Biol.* 167B:212). Crude enzyme preparations of BGUS from mollusks (e.g. snail, abalone, limpet) are commercially available and thus have been used for clinical and forensic analysis purposes. In some instances, however, crude enzyme preparations contain contaminants that interfere with either enzyme activity or downstream measurement of products (Nakamura et al. (2011) *Biosci. Biotechnol. Biochem.* 75:1506).

More recently, purified recombinant BGUS enzymes have been described, including variant forms of recombinant BGUS enzymes that have been modified to enhance enzymatic activity, temperature stability or both (see e.g., US Patent Publication 20160090582, issued as U.S. Pat. No. 9,920,306; US Patent Publication 20160237415, issued as U.S. Pat. No. 9,719,075; US Patent Publication 20170267985, issued as U.S. Pat. No. 9,909,111; Xiong, A-S. et al. (2007) *Prot. Eng. Design Select.* 20:319-325). For example, a genetically modified recombinant *E. coli* K12 BGUS enzyme is commercially available (IMCSzyme®; IMCS).

Accordingly, while variant forms of BGUS have been reported, there is still a need in the art for additional modified forms of BGUS enzymes having enhanced properties that are more efficient for use in drug testing.

SUMMARY OF THE INVENTION

The invention provides chimeric and other variant forms of BGUS enzymes that exhibit enhanced properties as compared to the parental enzymes from which they have been derived. In particular, the chimeric and other variant BGUS enzymes of the disclosure exhibit enhanced enzymatic activity, and/or an increased effective substrate range, and/or an increased effective pH range and/or an increased effective temperature range as compared to the parental enzymes from which they have been derived. Furthermore, the variant enzymes of the invention are produced recombinantly and thus can be prepared in a highly purified form without contaminating non-BGUS proteins.

Accordingly, in one aspect, the disclosure pertains to chimeric BGUS enzymes, which comprise at least one domain from a first BGUS enzyme and at least one domain from a second (different) BGUS enzymes. For example, in one aspect, the disclosure pertains to a chimeric beta-glucuronidase (BGUS) enzyme, which comprises at least one domain from a first BGUS enzyme operatively linked to at least one domain from a second BGUS enzyme, wherein the chimeric BGUS enzyme exhibits:

(i) an increased level of enzymatic activity for one or more substrates as compared to the first or second BGUS enzyme; or (ii) an increased effective range of substrates catalyzed as compared to the first or second BGUS enzyme; or (iii) an increased effective pH range for one or more substrates as compared to the first or second BGUS enzyme; or (iv) an increased effective temperature range for one or more substrates as compared to the first or second BGUS enzyme; or (v) an increase in enzyme stability as compared to the first or second BGUS enzyme; or (vi) any combination of (i)-(v).

In one embodiment, the first and second BGUS enzymes used in the chimeric BGUS enzyme are each from a species independently selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens, Homo sapiens, Lactobacillus brevis, Mus musculus, Parabacteroides* sp., *Staphylococcus* sp. and *Streptococcus agalactiae*. In one embodiment, the first BGUS enzyme is from *Aspergillus oryzae* and the second BGUS enzyme is from *Aspergillus terreus*. In one embodiment, the first BGUS enzyme is from *Brachyspira pilosicoli* and the second BGUS enzyme is from *Eubacterium eligens*.

In one embodiment, the chimeric BGUS enzyme comprises an N-terminal sugar-binding/Ig-like domain (SBI domain) and a C-terminal TIM-Barrel domain (TIMB domain) comprising a Loop 1 domain, wherein the chimeric BGUS enzyme comprises an SBI domain from the first BGUS enzyme and a TIMB domain and Loop 1 domain from the second BGUS enzyme. In one embodiment, the chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 17-24 and 121-137. In one embodiment, the chimeric BGUS enzyme is at least 95% homologous to an amino acid sequence shown in SEQ ID NOs: 17-24 and 121-137. In one embodiment, the chimeric BGUS enzyme is at least 90% (or 91%, 92%, 93%, 94%, 95%, 96%, 97%, 98% or 99%) homologous to an amino acid sequence shown in the SEQ ID NOs: 19 or 121-137. In one embodiment, the chimeric BGUS enzyme comprises an amino acid sequence shown in SEQ ID NOs: 19 or 121-137.

In another embodiment, the chimeric BGUS enzyme comprises an N-terminal sugar-binding/Ig-like domain (SBI domain) and a C-terminal TIM-Barrel domain (TIMB domain) comprising a Loop 1 domain, wherein the chimeric BGUS enzyme comprises an SBI domain from the first BGUS enzyme, a TIMB domain from the second BGUS enzyme, and a Loop 1 domain from the first BGUS enzyme. In one embodiment, the chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 25-30. In one embodiment, the chimeric BGUS enzyme is at least 95% homologous to an amino acid sequence shown in SEQ ID NOs: 25-30. In one embodiment, the chimeric BGUS enzyme is at least 90% (or 91%, 92%, 93%, 94%, 95%, 96%, 97%, 98% or 99%) homologous to the amino acid sequence shown in the SEQ ID NO: 26. In one embodiment, the chimeric BGUS enzyme comprises the amino acid sequence shown in SEQ ID NO: 26.

In another embodiment, the chimeric BGUS enzyme comprises an N-terminal sugar-binding/Ig-like domain (SBI domain) and a C-terminal TIM-Barrel domain (TIMB domain) comprising a Loop 1 domain, wherein the chimeric BGUS enzyme comprises an SBI domain and a TIMB domain from the first BGUS enzyme and a Loop 1 domain from the second BGUS enzyme. In one embodiment, the chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 31-36. In one embodiment, the chimeric BGUS enzyme is at least 95% homologous to an amino acid sequence shown in SEQ ID NOs: 31-36. In one embodiment, the chimeric BGUS enzyme is at least 90% (or 91%, 92%, 93%, 94%, 95%, 96%, 97%, 98% or 99%) homologous to the amino acid sequence shown in the SEQ ID NO: 31. In one embodiment, the chimeric BGUS enzyme comprises the amino acid sequence shown in SEQ ID NO: 31.

In another embodiment, the chimeric BGUS enzyme comprises a TIM-Barrel domain (TIMB domain) comprising a Counter-loop domain and a Loop 1 domain, wherein the chimeric BGUS enzyme comprises:

(a) a TIMB domain from a first BGUS enzyme, a Counter-loop domain from a second BGUS enzyme and a Loop 1 domain from the first BGUS enzyme; or (b) a TIMB domain from a first BGUS enzyme, a Counter-loop domain from the first BGUS enzyme and a Loop 1 domain from a second BGUS enzyme: or (c) a TIMB domain from a first BGUS enzyme, a Counter-loop domain from a second BGUS enzyme and a Loop 1 domain from the second BGUS enzyme.

In one embodiment, the chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 37-46. In one embodiment, the chimeric BGUS enzyme is at least 95% homologous to an amino acid sequence shown in SEQ ID NOs: 37-36. In one embodiment, the chimeric BGUS enzyme comprises an amino acid sequence shown in SEQ ID NOs: 37-46.

In another aspect, the invention pertains to a chimeric beta-glucuronidase (BGUS) enzyme, which comprises an N-terminal sugar-binding/Ig-like domain (SBI domain) and a C-terminal TIM-Barrel domain (TIMB domain) comprising a Loop 1 domain, wherein the chimeric BGUS enzyme comprises:

(a) an SBI domain from a first BGUS enzyme and a TIMB domain and Loop 1 domain from a second BGUS enzyme; or (b) an SBI domain from a first BGUS enzyme, a TIMB domain from a second BGUS enzyme, and a Loop 1 domain from the first BGUS enzyme; or (c) an SBI domain and a TIMB domain from a first BGUS enzyme and a Loop 1 domain from a second BGUS enzyme.

In various embodiments, the chimeric enzyme exhibits:
(i) an increased level of enzymatic activity for one or more substrates as compared to the first or second BGUS enzyme; or
(ii) an increased effective range of substrates catalyzed as compared to the first or second BGUS enzyme; or
(iii) an increased effective pH range for one or more substrates as compared to the first or second BGUS enzyme: or
(iv) an increased effective temperature range for one or more substrates as compared to the first or second BGUS enzyme; or
(v) an increase in enzyme stability as compared to the first or second BGUS enzyme; or
(vi) any combination of (i)-(v).

In various embodiments, the first and second BGUS enzymes are each from a species independently selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens. Homo sapiens, Lactobacillus brevis, Mus musculus, Parabacteroides* sp., *Staphylococcus* sp. and *Streptococcus agalactiae*. In one embodiment, the first BGUS enzyme is from *Aspergillus oryzae* and the second BGUS enzyme is from *Aspergillus terreus*.

In one embodiment, the chimeric BGUS enzyme comprises an SBI domain from a first BGUS enzyme and a TIMB domain and Loop 1 domain from a second BGUS enzyme. In one embodiment, this chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 17-24 and 121-137. In another embodiment, this chimeric BGUS enzyme is at least 90% (or 91%, 92%, 93%, 94%, 95%, 96%, 97%, 98% or 99%) homologous to an amino acid sequence shown in SEQ ID NO: 19. In yet another embodiment, this chimeric BGUS enzyme is at least 95% homologous to an amino acid sequence shown in SEQ ID NO: 19. In one embodiment, the chimeric BGUS enzyme comprises an amino acid sequence shown in SEQ ID NOs: 19 and 121-137.

In one embodiment, the chimeric BGUS enzyme comprises an SBI domain from a first BGUS enzyme, a TIMB domain from a second BGUS enzyme, and a Loop 1 domain from the first BGUS enzyme. In one embodiment, this chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 25-30. In another embodiment, this chimeric BGUS enzyme is at least 90% (or 91%, 92%, 93%, 94%, 95%, 96%, 97%, 98% or 99%) homologous to an amino acid sequence shown in SEQ ID NO: 26. In yet another embodiment, this chimeric BGUS enzyme is at least 95% homologous to an amino acid sequence shown in SEQ ID NO: 26. In one embodiment, the chimeric BGUS enzyme comprises the amino acid sequence shown in SEQ ID NO: 26.

In one embodiment, the chimeric BGUS enzyme comprises an SBI domain and a TIMB domain from a first BGUS enzyme and a Loop 1 domain from a second BGUS enzyme. In one embodiment, this chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 31-36. In another embodiment, this chimeric BGUS enzyme is at least 90% (or 91%, 92%, 93%, 94%, 95%, 96%, 97%, 98% or 99%) homologous to an amino acid sequence shown in SEQ ID NO: 31. In yet another embodiment, this chimeric BGUS enzyme is at least 95% homologous to an amino acid sequence shown in SEQ ID NO: 31. In one embodiment, the chimeric BGUS enzyme comprises the amino acid sequence shown in SEQ ID NO: 31.

In another aspect, the disclosure pertains to a chimeric BGUS enzyme, which comprises a TIM-Barrel domain (TIMB domain) comprising a Counter-loop domain and a Loop 1 domain, wherein the chimeric BGUS enzyme comprises:

(a) a TIMB domain from a first BGUS enzyme, a Counter-loop domain from a second BGUS enzyme and a Loop 1 domain from the first BGUS enzyme; or (b) a TIMB domain from a first BGUS enzyme, a Counter-loop domain from the first BGUS enzyme and a Loop 1 domain from a second BGUS enzyme; or (c) a TIMB domain from a first BGUS enzyme, a Counter-loop domain from a second BGUS enzyme and a Loop 1 domain from the second BGUS enzyme.

In various embodiments, the chimeric BGUS enzyme exhibits:
(i) an increased level of enzymatic activity for one or more substrates as compared to the first or second BGUS enzyme; or
(ii) an increased effective range of substrates catalyzed as compared to the first or second BGUS enzyme; or
(iii) an increased effective pH range for one or more substrates as compared to the first or second BGUS enzyme; or
(iv) an increased effective temperature range for one or more substrates as compared to the first or second BGUS enzyme; or
(v) an increase in enzyme stability as compared to the first or second BGUS enzyme; or
(vi) any combination of (i)-(v).

In various embodiments, the first and second BGUS enzymes are each from a species independently selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens, Homo sapiens, Lactobacillus brevis, Mus musculus, Parabacteroides* sp., *Staphylococcus* sp. and *Streptococcus agalactiae*. In one embodiment, the first BGUS enzyme is from *Brachyspira pilosicoli* and the second BGUS enzyme is from *Eubacterium eligens* or the first BGUS enzyme is from *Eubacterium eligens* and the second BGUS enzyme is from *Brachyspira pilosicoli*.

In one embodiment, this chimeric BGUS enzyme is at least 80% (or 85%, or 90%, or 91% or 92% or 93% or 94% or 95% or 96% or 97% or 98% or 99%) homologous to an amino acid sequence shown in SEQ ID NOs: 37-46. In one embodiment, this chimeric BGUS enzyme is at least 90% (or 91%, 92%, 93%, 94%, 95%, 96%, 97%, 98% or 99%) homologous to an amino acid sequence shown in SEQ ID NO: 40 or 45. In another embodiment, this chimeric BGUS enzyme is at least 95% homologous to an amino acid sequence shown in SEQ ID NO: 40 or 45. In yet another embodiment, this chimeric BGUS enzyme comprises the amino acid sequence shown in SEQ ID NO: 40 or 45.

In yet another aspect, the disclosure pertains to BGUS enzymes (including the chimeric enzymes described before) that comprise one or more point mutations (i.e., amino acid substitutions at specified amino acid positions) as compared to the parental enzyme from which the variant is derived. Accordingly, in another aspect, the disclosure pertains to a variant beta-glucuronidase (BGUS) enzyme derived from a parental BGUS enzyme, the variant BGUS enzyme comprising an amino acid sequence at least 80% (or 85%, or 90%, or 91% or 92% or 93% or 94% or 95% or 96% or 97% or 98% or 99%) homologous to an amino acid sequence shown in SEQ ID NOs: 1-46 and 138, and comprising (i) at least one amino acid substitution, as compared to the parental BGUS enzyme, at at least one amino acid position corresponding to F294, T295, I450, Q451, A452 and/or G563 of SEQ ID NO: 5; or (ii) at least one cysteine substitution, as compared to the parental BGUS enzyme, at at least one amino acid position corresponding to Q8, S73, P489, Q570 or K588 of SEQ ID NO: 10, wherein the variant BGUS enzyme exhibits:
 (i) an increased level of enzymatic activity for one or more substrates as compared to the parental BGUS enzyme; or
 (ii) an increased effective range of substrates catalyzed as compared to the parental BGUS enzyme; or
 (iii) an increased effective pH range for one or more substrates as compared to the parental BGUS enzyme; or
 (iv) an increased effective temperature range for one or more substrates as compared to the parental BGUS enzyme; or
 (v) an increase in enzyme stability as compared to the parental BGUS enzyme; or
 (vi) any combination of (i)-(v).

In one embodiment, the variant comprises an amino acid sequence at least 90% homologous to a sequence shown in SEQ ID NOs: 47-137. In one embodiment, the variant comprises an amino acid sequence selected from the group consisting of the amino acid sequences shown in SEQ ID NOs: 47-137.

In yet another aspect, the disclosure pertains to a variant beta-glucuronidase (BGUS) enzyme derived from a parental BGUS enzyme, the variant BGUS enzyme comprising an amino acid sequence at least 80% (or 85%, or 90%, or 91% or 92% or 93% or 94% or 95% or 96% or 97% or 98% or 99%) homologous to an amino acid sequence shown in SEQ ID NOs: 1-46 and 138, and comprising at least one amino acid substitution, as compared to the parental BGUS enzyme, at at least one amino acid position corresponding to F294, T295, I450, Q451, A452 and/or G563 of SEQ ID NO: 5, wherein the variant BGUS enzyme exhibits:
 (i) an increased level of enzymatic activity for one or more substrates as compared to the parental BGUS enzyme; or
 (ii) an increased effective range of substrates catalyzed as compared to the parental BGUS enzyme; or
 (iii) an increased effective pH range for one or more substrates as compared to the parental BGUS enzyme; or
 (iv) an increased effective temperature range for one or more substrates as compared to the parental BGUS enzyme; or
 (v) an increase in enzyme stability as compared to the parental BGUS enzyme; or
 (vi) any combination of (i)-(v).

In one embodiment, the variant BGUS enzyme is at least 90% homologous to an amino acid sequence shown in SEQ ID NOs: 1-46 and 138. In another embodiment, the variant BGUS enzyme is at least 95% homologous to an amino acid sequence shown in SEQ ID Nos: 1-46 and 138. In another embodiment, the variant BGUS enzyme is at least 98% homologous to an amino acid sequence shown in SEQ ID NOs: 1-46 and 138. In other embodiments, the variant BGUS enzyme is at least 90%, 91%, 92%, 93%, 94%, 95%, 96%, 97%, 98%, 99% or 99.5% homologous to an amino acid sequence shown in SEQ ID Nos: 1-46 and 138.

In various embodiments of the point variants, the parental BGUS enzyme is from a species selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens, Homo sapiens, Lactobacillus brevis, Mus musculus, Parabacteroides* sp., *Staphylococcus* sp. and *Streptococcus agalactiae*.

In one embodiment, the variant BGUS enzyme comprises an amino acid substitution, as compared to the parental BGUS enzyme, at an amino acid position corresponding to F294 of SEQ ID NO: 5. In specific embodiments, this variant BGUS enzyme comprises an amino acid sequence selected from the group consisting of the amino acid sequences shown in SEQ ID NOs: 47-54 (corresponding to BpF294A, BpF294I, BpF294V, BpF294Y, BpF294L, BpF294W, EeF303W and EeF303S, respectively).

In another embodiment, the variant BGUS enzyme comprises an amino acid substitution, as compared to the parental BGUS enzyme, at an amino acid position corresponding to T295 of SEQ ID NO: 5. In specific embodiments, this variant BGUS enzyme comprises an amino acid sequence selected from the group consisting of the amino acid sequences shown in SEQ ID NOs: 55-63, (corresponding to BpT295A, BpT295C, BpT295F, BpT295I, BpT295K, BpT295S, BpT295V, EeK304A and EeK304V, respectively).

In another embodiment, the variant BGUS enzyme comprises an amino acid substitution, as compared to the parental BGUS enzyme, at an amino acid position corresponding to I450 of SEQ ID NO: 5. In specific embodiments, this variant BGUS enzyme comprises an amino acid sequence selected from the group consisting of the amino acid sequences shown in SEQ ID NOs: 64-76 and 121-124 (corresponding to BpI450F, BpI450K, BpI450L, BpI450M, BpI450Q, BpI450D, BpI450V, EeV459F, EeV459L, EeV459W, EeV459C, EeV459G, EeV459E, Rxn3Y447L, Rxn3Y447P, Rxn3Y447I and Rxn3Y447Q, respectively).

In another embodiment, the variant BGUS enzyme comprises an amino acid substitution, as compared to the parental BGUS enzyme, at an amino acid position corresponding to Q451 of SEQ ID NO: 5. In specific embodiments, this variant BGUS enzyme comprises an amino acid sequence selected from the group consisting of the amino acid sequences shown in SEQ ID NOs: 77-82 and 125-130 (corresponding to BpQ451D, BpQ451E, BpQ451G, BpQ451 S, BpQ451V, BpQ451K, Rxn3G448E, Rxn3G448K, Rxn3G448F, Rxn3G448L, Rxn3G448C and Rxn3G448W, respectively).

In another embodiment, the variant BGUS enzyme comprises an amino acid substitution, as compared to the parental BGUS enzyme, at an amino acid position corresponding to A452 of SEQ ID NO: 5. In specific embodiments, this variant comprises an amino acid sequence selected from the group consisting of the amino acid sequences shown in SEQ ID NOs: 83-92 and 131-137 (corresponding to BpA452D, BpA452K, BpA452N, BpA452G, BpA452E, BpA452Q, EeG461A, EeG461H, EeG461N, EeG461S, Rxn3D449Q, Rxn3D449G, Rxn3D449R, Rxn3D449K, Rxn3D449S, Rxn3D449C and Rxn3D449E, respectively).

In another embodiment, the variant BGUS enzyme comprises an amino acid substitution, as compared to the parental BGUS enzyme, at an amino acid position corresponding to G563 of SEQ ID NO: 5. In specific embodiments, this variant comprises an amino acid sequence selected from the group consisting of the amino acid sequences shown in SEQ ID NOs: 93-100 (corresponding to BpG563E, BpG563A, BpG563D, BpG563Y, EeS571G, EeS571N, Rxn3G560V and Rxn3G560E, respectively).

In another embodiment, the variant BGUS enzyme comprises amino acid substitutions, as compared to the parental BGUS enzyme, at amino acid positions corresponding to F294 and T295 of SEQ ID NO: 5. In specific embodiments, the variant comprises an amino acid sequence selected from the group consisting of the amino acid sequences shown in SEQ ID NOs: 101-106 (corresponding to BpF294Y/T295C, BpF294Y/T295I, BpF294Y/T295V, BpF294Y/T295F, BpF294Y/T295M and BpF294Y/T295K, respectively).

In another embodiment, the variant BGUS enzyme comprises amino acid substitutions, as compared to the parental BGUS enzyme, at amino acid positions corresponding to T295 and I450 of SEQ ID NO: 5. In specific embodiments, the variant comprises an amino acid sequence selected from the group consisting of the amino acid sequences shown in SEQ ID NOs: 107-110 (corresponding to BpT295V/I450L, BpT295V/I450M, BpT295V/I450Y and BpT295V/I450V, respectively).

In another embodiment, the variant BGUS enzyme comprises amino acid substitutions, as compared to the parental BGUS enzyme, at amino acid positions corresponding to I450 and Q451 of SEQ ID NO: 5. In specific embodiments, the variant comprises an amino acid sequence selected from the group consisting of the amino acid sequences shown in SEQ ID NOs: 111 and 112 (corresponding to BpI450M/Q451D and BpI450Q/Q451 D, respectively).

In another embodiment, the variant BGUS enzyme comprises amino acid substitutions, as compared to the parental BGUS enzyme, at amino acid positions corresponding to Q451 and A452 of SEQ ID NO: 5. In specific embodiments, the variant comprises an amino acid sequence selected from the group consisting of the amino acid sequences shown in SEQ ID NOs: 113-117 (corresponding to BpQ451D/A452E, BpQ451D/A452G, BpQ451D/A452Q, BpQ451D/A452S and BpQ451D/A452R, respectively).

In another aspect, the disclosure pertains to a variant beta-glucuronidase (BGUS) enzyme derived from a parental BGUS enzyme, the variant BGUS enzyme comprising an amino acid sequence at least 80% (or 85%, or 90%, or 91% or 92% or 93% or 94% or 95% or 96% or 97% or 98% or 99%) homologous to an amino acid sequence shown in SEQ ID NOs: 1-46 and 138, and comprising at least one cysteine substitution, as compared to the parental BGUS enzyme, at at least one amino acid position corresponding to Q8, S73, P489, Q570 or K588 of SEQ ID NO: 10, wherein the variant BGUS enzyme exhibits:
(i) an increased level of enzymatic activity for one or more substrates as compared to the parental BGUS enzyme; or
(ii) an increased effective range of substrates catalyzed as compared to the parental BGUS enzyme; or
(iii) an increased effective pH range for one or more substrates as compared to the parental BGUS enzyme; or
(iv) an increased effective temperature range for one or more substrates as compared to the parental BGUS enzyme; or
(v) an increase in enzyme stability as compared to the parental BGUS enzyme; or
(vi) any combination of (i)-(v).

In specific embodiments, the cysteine-substituted variant BGUS enzyme comprises an amino acid sequence selected from the group consisting of the amino acid sequences shown in SEQ ID NOs: 118-120 (corresponding to EeQ8C/S73C, EeK588C and EeP489C/Q570C, respectively).

Formulations comprising any of the chimeric or other variant BGUS enzymes are also provided. In one embodiment, the formulation comprises the chimeric or variant BGUS enzyme and at least one excipient. In one embodiment, the at least one excipient is selected from the group consisting of water, salts, buffers, sugars and amino acids. In one embodiment, the formulation is free of polymers and detergents. In one embodiment, the formulation is an aqueous formulation. In one embodiment, the formulation is a lyophilized formulation. Packaged formulations, comprising the BGUS enzyme formulation and a container, are also provided.

In other aspects, the disclosure pertains to DNA constructs encoding the chimeric or variant BGUS enzymes of the disclosure, including expression vectors comprising such DNA constructs, as well as host cells comprising such expression vectors. Methods for expressing (i.e., producing) the chimeric or variant BGUS enzymes using such host cells are also provided.

In yet another aspect, the disclosure pertains to methods of hydrolyzing a substrate comprising a glucuronide linkage. In one embodiment, the method comprises contacting the substrate with any of the chimeric or variant BGUS enzymes of the disclosure such that hydrolysis of the glucuronide linkage occurs. In various embodiments, the substrate is selected from the group consisting of morphine-3-β-D-glucuronide (MOR), oxymorphone-3-β-D-glucuronide (OMOR), hydromorphone-3-(β-D-glucuronide (HMOR), codeine-6-β-D-glucuronide (COD), dihydrocodeine-6-β-D-glucuronide (DCOD), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc), and/or temazepam glucuronide (TEM gluc).

In one embodiment, the disclosure provides a method of hydrolyzing codeine-6-β-D-glucuronide (COD), the method comprising contacting the substrate with a variant BGUS enzyme that comprises an amino acid substitution, as compared to its parental BGUS enzyme, at an amino acid position corresponding to Q451 of SEQ ID NO: 5, such that hydrolysis of the glucuronide linkage occurs. In one embodiment, the variant BGUS enzyme comprises the amino acid sequence shown in SEQ ID NO: 76 (corresponding to the BpQ451D variant). In another embodiment of this method, the variant BGUS enzyme comprises the amino acid sequence shown in SEQ ID NO: 113 (BpGUS comprising Q451D/A452E mutations). In another embodiment of this method, the variant BGUS enzyme comprises the amino acid sequence shown in SEQ ID NO: 114 (BpGUS comprising Q451D/A452G mutations). In another embodiment of this method, the variant BGUS enzyme comprises the amino acid sequence shown in SEQ ID NO: 115 (BpGUS comprising Q451D/A452Q mutations). In another embodiment of this method, the variant BGUS enzyme comprises the amino acid sequence shown in SEQ ID NO: 116 (BpGUS comprising Q451D/A452S mutations). In another embodiment of this method, the variant BGUS enzyme comprises the amino acid sequence shown in SEQ ID NO: 117 (BpGUS comprising Q451D/A452R mutations).

Other features and aspects of the invention are described in further detail herein.

BRIEF DESCRIPTION OF THE DRAWINGS

FIG. 1 shows an alignment of the amino acid sequences for the EeGUS (SEQ ID NO: 10), AoGUS (SEQ ID NO: 1), Rxn3 (SEQ ID NO: 19), AtGUS (SEQ ID NO: 2), EcE1F (SEQ ID NO: 9), BpGUS (SEQ ID NO: 5), BmGUS (SEQ ID NO: 6), CpGUS (SEQ ID NO: 7), StpGUS (SEQ ID NO: 15), LbLR2D (SEQ ID NO: 12), SaGUS (SEQ ID NO: 16), HsGUS (SEQ ID NO: 11), BfGUS (SEQ ID NO: 3), PmGUS (SEQ ID NO: 14) and BuGUS (SEQ ID NO: 4) enzymes. Amino acid residue numbering is shown on the right. Key conserved residues are indicated by (.) (:) and (*) beneath the sequences. Variant Sites 1, 2 and 3 that were used for point mutagenesis indicated in black.

FIG. 2 is an alignment of the CpGUS (SEQ ID NO: 7), EeGUS (SEQ ID NO: 10), EcGUS (SEQ ID NO: 8) and AoGUS (SEQ ID NO: 1) amino acid sequences showing the locations of the C-Loop, Loop 1, Loop 2, M-Loop, Y-loop and N-K motif regions.

FIG. 3 is an alignment of the AoGUS (SEQ ID NO: 1), AtGUS (SEQ ID NO: 2) and EcE1F (SEQ ID NO: 9) amino acid sequences showing the locations of the Restriction Site 1, Restriction Site 2, Loop 1 Site A, Loop 1 Site B, Restriction Site 3 and Restriction Site 4 regions used to create chimeric enzymes.

FIG. 4 is an alignment of the BpGUS (SEQ ID NO: 5) and EeGUS (SEQ ID NO: 10) amino acid sequences showing the C-Loop Site, the Loop 1 Swap 1 and Loop 1 Swap 2 locations used to create chimeric enzymes.

DETAILED DESCRIPTION OF THE INVENTION

Figure 5:
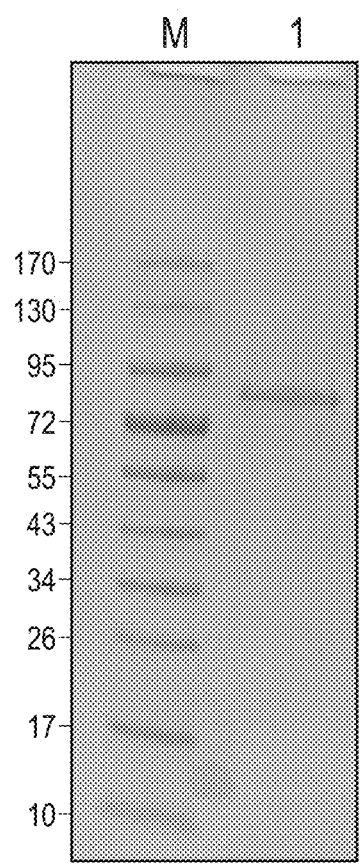
FIG. 5 is a photograph of a 4-20% gradient SDS-PAGE showing the enzyme purity observed by purifying BGUS enzymes, chimeras, and variants via IMCStips tip technologies. Lane M=molecular weight markers. Lane 1=purified BGUS enzyme.

The invention pertains to mutated β-glucuronidase enzymes, in particular chimeric and other variant forms of BGUS enzymes, having enhanced properties as compared to the parental enzyme from which the variant form was derived, as well as packaged formulations thereof and methods of using the enzymes for hydrolysis of glucuronide linkages.

Structures for GH2 BGUS enzymes have been solved from multiple sources, both with and without ligands in the active site (Jain et al. (1996) *Nature Struct. Biol.* 3:375; Wallace et al. (2010) *Science* 330:831; Roberts et al. (2013) *Mol. Pharmacol.* 84:208; Hassan et al. (2013) *PLoS ONE* 8:e79687; Wallace et al. (2015) *Chem. Biol.* 22:1238; Pollet et al. (2017) *Structure* 25:967; Pellock et al. (2018) *ACS Central Science*). The approximately 70 kD enzyme monomer (approximately 600 amino acids) has three domains: an N-terminal beta-sandwich described as a sugar-binding domain or jelly-roll barrel (approximately 180 amino acids); a second beta-sandwich described as an immunoglobulin-like domain (approximately 110 amino acids); and an alpha/beta eight-strand TIM barrel (approximately 310 amino acids). The monomers form dimers with the individual active sites directly opposite each other. The dimers form tetramers, which are thought to be the active form (Stahl and Touster (1971) *J. Biol. Chem.* 246:5398; see also Yeom et al. (2017) *PLoS ONE* 12:e0170398). Additionally, higher order complexes have been observed, although their physiological relevance, if any, is unknown.

The function of each domain in BGUS can be inferred from their structural homologies and similarities to other proteins sharing similar domains. The sugar-binding domain contains residues that are possibly important in lysosome targeting based on similarities of human BGUS to cathepsin D (Hassan et al. (2013) *PLoS ONE* 8:e79687). The immunoglobulin-like domain possibly facilitates protein-protein interactions, promoting the formation of multimeric BGUS structures (Burchett et al. (2015) *PLoS ONE*). The TIM-barrel domain, which contains the active site, is physicochemically similar to clusters of residues (that determine the common TIM-barrel folding pattern) in both the GH2 family of enzymes and non-homologous enzyme families (Wierenga (2001) *FEBS Letters* 492:193-198). Furthermore, TIM-barrels can contain several flexible loops that are involved in binding different substrates (Wierenga (2001) *FEBS Letters* 492:193-198).

Several bacterial BGUS active site loops have been characterized and their conservation and flexibility vary, depending on the loop and its relationship to the active site. Some bacterial BGUS have "Loop 1," believed involved with processing small substrates (Pollet et al. (2017) *Structure*). By contrast, other BGUS, including a majority of bacterial and eukaryotic enzymes (especially mammalian and mollusk enzymes), have a gap ("No Loop" or NL) in sequence alignments of GH2 beta-glucuronidase enzymes. It has been suggested this makes NL enzymes better able to process larger substrates (Wallace et al. (2015) *Chem. Biol.*). The length of Loop 1 ranges from approximately 15 to 30 amino acids (Pollet et al. (2017) *Structure*), and the sequence of Loop 1 is generally non-conserved (Wallace et al. (2015) *Chem. Biol.*; Pollet et al. (2017) *Structure*). Adjacent to Loop 1 in the active site is "Loop 2," which also has variability in length and amino acid composition (Pollet et al. (2017) *Structure*). Pollet et al. further describe "mini-Loop 1" (mL1) and "mini-Loop 2" (mL2) which are shorter versions of Loop 1 and Loop 2, respectively (Pollet et al. (2017) *Structure*).

A unique conserved region in BGUS called the "N-K motif" distinguishes them from other activities in the GH2 family, especially beta-galactosidases (BGAL), which otherwise often share significant homology with BGUS enzymes (Wallace et al. (2015) *Chem. Biol.*; Pollet et al. (2017) *Structure*). The N-K motif contains two conserved residues, asparagine and lysine, that form contacts with the carboxylic acid of glucuronic acid in the active site (Wallace et al. (2015) *Chem. Biol.*). The "Y-loop" is a region conserved in all BGUS sequences identified so far: it contains several aromatic residues that are implicated in substrate binding (Wallace et al. (2015) *Chem. Biol.*). In addition, BGUS, in contrast to BGAL, contain a tyrosine residue near the glucuronic acid binding site that only permits the processing of β-linked substrates due to steric occlusion (Wallace et al. (2015) *Chem. Biol.*). Furthermore, based on the *Escherichia coli* BGUS structure, an "M-loop" region has been described near one of the catalytic glutamic acid residues in the active site (Wallace et al. (2015) *Chem. Biol.*).

Analogous regions have been described for the GH2 BGUS from *Aspergillus oryzae* (AoGUS) such as "Loop B" (N-K motif), "Loop C" (Y-loop), "Loop D" (Loop 1), "Loop E" (Loop 2), and "Loop F" (M-loop) (Lv et al. (2017) *J. Biol. Chem.*). Furthermore, Lv et al. (2017) describe a "Loop A" they claim participates with the N-K motif in polar interactions with the GlcU moiety of 3-O-mono-beta-D-glucuronide (GAMG) substrate.

Furthermore, as described herein, a sequence referred to herein as the Counter-loop (C-loop) precedes and overlaps with Loop A described by Lv et al. (2017). As described herein, the C-loop corresponds to residues 142-163 in AoGUS, whereas Loop A consist of residues 159-172 (Lv et al. (2017) *J. Biol. Chem.*); both are located near the active site in the crystal structure of AoGUS (Lv et al. (2017) *J. Biol. Chem.*). Without being bound by theory, it is hypothesized that the C-loop, which is poorly conserved among BGUS enzymes, may be important for substrate binding and interactions with the aglycone. For example, it has been observed that the C-loop of one enzyme in particular, EeGUS from *Eubacterium eligens*, is unusually long and contains an unusually high content of methionine and glycine residues. Furthermore, without being bound by theory, it is hypothesized that, due to flexibility and residue composition, this C-loop is important for substrate recognition and activity.

An amino acid alignment of fifteen BGUS enzymes is shown in FIG. 1. FIG. 2 shows an alignment of four BGUS sequences indicating the C-loop, Loop 1, Loop 2, M-loop, Y-loop and NK motif regions.

Mutagenesis is a powerful approach for determining residues that are important in protein structure and function, and can be used to possibly produce favorable properties of a target protein such as improved thermostability or function. The mutations can be made in the nucleotide sequence of the gene coding for the protein, and the modified gene can be expressed to produce variants of the original template sequence. Directed Evolution (DE) is a technique whereby amino acids are randomly changed throughout a sequence and then improvements, such as thermostability, pH range, or substrate profile, are identified in a subsequent screen of variants. This technique has been used successfully to create glutaraldehyde and formaldehyde resistant EcGUS variants (Matsumura et al. (1999) *Nature Biotech.* 17:696-701). Key residues that substantially impact a property of an enzyme can be altered specifically, if they are known or can be predicted based on sequence and structural data, by using site-directed saturation mutagenesis (Folz et al. (1988) *J. Biol. Chem.* 263:2070-2078). Substitution of a single key residue in a sequence will yield 20 possible variants (including the original template). This can be achieved by using site-saturation mutagenesis such that codons for all 20 possible amino acids are each substituted at the same key position in the sequence (Steffens et al. (2007) *J. Biomol. Tech.* 18:147-149; Chronopoulou et al. (2011) *Curr. Protocols Protein Sci.* 63:26.6.1-26.6.10).

Some key residues have been described and partially characterized in certain BGUS. In *E. coli* BGUS, residue 559 has been shown to alter activity and thermostability of the protein (Flores et al. (2002) *J. Mol. Biol.* 315:325-337; US Patent Publication 20160090582A1 issued as U.S. Pat. No. 9,920,306). In Li-3 from *A. oryzae*, variants of residues 292 and 293 have been described to shift the geometry of the active site glutamic acid residues and also alter protein thermostability (Feng et al. (2016) *Ind. Eng. Chem. Res.* 55:5474-5483). M-loop residues have been described in Li-3 (residue 447) and EcGUS (residues 446 and 448) as having interactions with the aglycone of substrates and BGUS inhibitors (Roberts et al. (2013) *Mol. Pharm.* 84:208-217; Wallace et al. (2015) *Chem. Biol.* 22(9): 1238-1249; Lv et al. (2017) *J. Bio. Chem.*). Furthermore, addition of the residues glycine-leucine-cysteine (GLC) to the C-terminal end of an EcGUS variant has been shown to improve protein stability (US Patent Publication 20160090582A1, issued as U.S. Pat. No. 9,920,306).

While some BGUS are currently available and suitable for forensic and clinical applications, as described herein the activity of BGUS has been further improved by domain-swapping among different BGUS and using site-saturation mutagenesis on key residues. Described herein are novel BGUS chimeras and other variants generated by domain-swapping and site-saturation mutagenesis. These variants have improved activities against target substrates, and/or demonstrate valuable changes in their pH range and/or stability.

Various aspects of the invention are described in further detail in the following subsections.

I. Variant β-Glucuronidase Enzymes

As used herein, the term "β-glucuronidase enzyme", also referred to as "β-glucuronidase" or "BGUS", refers to an enzyme that hydrolyzes glucuronide linkages. A "parental" or "template" BGUS enzyme refers to the starting enzyme that is modified to create a "variant" BGUS enzyme. A "variant" BGUS enzyme refers to a modified form of the enzyme in which one or more modifications, such as amino acid swaps, substitutions, deletions and/or insertions, have been made such that the amino acid sequence of the variant BGUS enzyme differs from the parental or template amino acid sequence. Thus, the "variant" BGUS enzyme is derived from the "parental" or "template" BGUS enzyme through introduction of one or more modifications. The parental or template BGUS amino acid sequence can be a "wild-type" BGUS sequence, i.e., a naturally-occurring unmodified BGUS enzyme. Alternatively, the parental or template BGUS amino acid sequence may itself be modified as compared to a "wild-type" sequence. For example, a chimeric BGUS enzyme as described herein can be used as the template enzyme for introducing additional modification, such as one or more amino acid substitutions.

In certain embodiments, the chimeric and other variant BGUS enzymes are described as having substantial homology to a specified amino acid sequence disclosed herein. The term "substantial homology" indicates that two amino acid sequences, when optimally aligned and compared, are identical, with appropriate insertions or deletions, in at least about 80% of the amino acids, usually at least about 90% to 95%, and more preferably at least about 98% to 99% to 99.5% of the nucleotides.

The percent identity between two sequences is a function of the number of identical positions shared by the sequences (i.e., % homology=# of identical positions/total # of positions ×100), taking into account the number of gaps, and the length of each gap, which need to be introduced for optimal alignment of the two sequences. The comparison of sequences and determination of percent identity between two sequences can be accomplished using mathematical algorithm, as described in the non-limiting examples below. Methods and algorithms for determining the % homology between two protein sequences are well established in the art.

For example, the percent identity between two amino acid sequences can be determined using the Needleman and Wunsch (*J. Mol. Biol.* (48):444-453 (1970)) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. Furthermore, a protein amino acid sequence can be used as a "query sequence" to perform a search against public databases to, for example, identify related sequences. Such searches can be performed using the XBLAST programs (version 2.0) of Altschul, et al. (1990) *J. Mol. Biol.* 215:403-10. BLAST protein searches can be performed with the XBLAST program, score=50, word-length=3 to obtain amino acid sequences homologous to the protein molecules of the invention. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used. See http://www.ncbi.nlm.nih.gov.

The amino acid sequences of fifteen BGUS enzymes suitable for use as parental or template enzymes are shown in the alignment of FIG. 1. Moreover, the alignment shown in FIG. 1 can be used as a model alignment for determining % homology (i.e., % identity), between two BGUS enzyme sequences. Cloning, expression and purification of BGUS enzymes is described in Examples 1-2.

In one embodiment, a variant BGUS enzyme of the disclosure is a chimeric BGUS enzyme, which comprise at least one domain from a first BGUS enzyme and at least one domain from a second (different) BGUS enzymes. A chimeric BGUS enzyme of the disclosure typically exhibits altered, and typically enhanced, activity as compared to one or both of the BGUS enzymes from which it is derived. For example, in one aspect, the disclosure pertains to a chimeric beta-glucuronidase (BGUS) enzyme, which comprises at least one domain from a first BGUS enzyme operatively linked to at least one domain from a second BGUS enzyme, wherein the chimeric BGUS enzyme exhibits:

(i) an increased level of enzymatic activity for one or more substrates as compared to the first or second BGUS enzyme; or (ii) an increased effective range of substrates catalyzed as compared to the first or second BGUS enzyme; or (iii) an increased effective pH range for one or more substrates as compared to the first or second BGUS enzyme; or (iv) an increased effective temperature range for one or more substrates as compared to the first or second BGUS enzyme; or (v) an increase in enzyme stability as compared to the first or second BGUS enzyme; or (vi) any combination of (i)-(v).

Various embodiments of chimeric BGUS enzymes are described in further detail below in subsections A and B below.

In one embodiment, a variant BGUS enzyme of the disclosure comprises one or more point mutations (i.e., amino acid substitutions) as compared to a parental BGUS enzyme from which it is derived. Various embodiments of point mutant BGUS enzymes are described in further detail below in subsection C.

In yet another embodiment, a variant BGUS enzyme of the disclosure comprises a combination of modifications, such as being a chimeric enzymes, having at least one domain from a first BGUS enzyme and at least one domain from a second BGUS enzyme, as well as comprising one or more point mutations (i.e., amino acid substitutions) as compared to the parental BGUS enzyme(s) from which it is derived. Various embodiments of combination mutant BGUS enzymes are described in further detail below in subsection D.

A. Sugar-Binding Domain/Ig-Like Domain, TIM-Barrel and/or Loop 1 Swaps

In one aspect, the disclosure provides chimeric BGUS enzymes in which the sugar-binding domain/Ig-like domain, TIM-barrel domain and/or Loop 1 have been swapped between two different BGUS enzymes. Accordingly, in one embodiment, the invention provides a chimeric beta-glucuronidase (BGUS) enzyme, which comprises an N-terminal sugar-binding/Ig-like domain (SBI domain) and a C-terminal TIM-Barrel domain (TIMB domain) comprising a Loop 1 domain, wherein the chimeric BGUS enzyme comprises:

(a) an SBI domain from a first BGUS enzyme and a TIMB domain and Loop 1 domain from a second BGUS enzyme; or (b) an SBI domain from a first BGUS enzyme, a TIMB domain from a second BGUS enzyme, and a Loop 1 domain from the first BGUS enzyme; or (c) an SBI domain and a TIMB domain from a first BGUS enzyme and a Loop 1 domain from a second BGUS enzyme.

For BGUS enzymes, which contain approximately 600 amino acids, the sugar-binding domain corresponds to the approximately 180 amino acids at the N-terminus, with the Ig-like binding domain corresponding to the next approximately 110 residues and the TIM-barrel domain corresponding to the approximately 310 amino acids at the C-terminus. Accordingly, the combined sugar-binding/Ig-like domain (SBI domain) corresponds to the approximately 290 amino acids at the N-terminus and the TIM-barrel domain (TIMB) corresponds to the approximately 310 amino acids at the C-terminus. To swap the SBI domain of one BGUS enzyme and the TIMB domain of a second BGUS enzyme, one of ordinarily skill in the art can readily identify the appropriate regions based on the known BGUS structures/amino acid sequences and recombinantly link the N-terminal approximately 290 amino acids from one BGUS enzyme to the C-terminal approximately 310 amino acids from a second BGUS enzyme. Furthermore, the Loop 1 region, located within the TIMB domain, is indicated in FIGS. 2 and 3. Approaches for creating the SBI domain. TIMB domain and/or Loop 1 swaps are described in detail in Example 5, using the restriction sites shown in FIG. 3.

In various embodiments, the chimeric enzyme exhibits:

(i) an increased level of enzymatic activity for one or more substrates as compared to the first or second BGUS enzyme; or (ii) an increased effective range of substrates catalyzed as compared to the first or second BGUS enzyme; or (iii) an increased effective pH range for one or more substrates as compared to the first or second BGUS enzyme; or (iv) an increased effective temperature range for one or more substrates as compared to the first or second BGUS enzyme: or (v) an increase in enzyme stability as compared to the first or second BGUS enzyme; or (vi) any combination of (i)-(v).

As used herein, an "increased effective range of substrates" means that the chimeric enzyme is active across a broader panel (i.e., higher number) of substrates under the same reaction conditions as compared to one or both parental enzymes (i.e., the unmodified first and/or second BGUS enzyme). Typically, an enzyme is "active" when it has at least 50% activity (or at least 60%, at least 70% or at least 80% activity) against each substrate in the range under the same defined reaction conditions (e.g., at a particular temperature and pH). For example, a parental enzyme 1 may have an effective substrate range of A, B and C at a specified temperature and pH, and a parental enzyme 2 may have an effective substrate range of C, D and E at that same temperature and pH. A chimeric enzyme composed of a mixture of the SBI domain, TIMB domain and/or Loop 1 domain of enzymes 1 and 2 may have an effective substrate range of A, B, C, D and E at that temperature and pH. Thus, this effective substrate range of the chimeric enzyme (i.e., A, B, C, D and E) is greater than the effective substrate range of each of the parental enzymes (i.e., greater than A, B and C for enzyme 1 and greater than C, D and E for enzyme 2).

As used herein, an "increased effective pH range for one or more substrates" means that the chimeric enzyme is active across a wider spectrum of pH values for the same substrate(s) under the same reaction conditions as compared to one or both parental enzymes (i.e., the unmodified first and/or second BGUS enzyme). For example, a parental enzyme 1 may have an effective pH range of 5.0-6.5, and a parental enzyme 2 may have an effective pH range of 6.0-7.5. A chimeric enzyme composed of a mixture of the SBI domain, TIMB domain and/or Loop 1 domain of enzymes 1 and 2 may have an effective pH range of 5.0-7.5. Thus, this effective pH range of the chimeric enzyme (i.e., 5.0-7.5) is greater than the effective pH range of each of the parental enzymes (i.e., greater than 5.0-6.5 for enzyme 1 and greater than 6.0-7.5 for enzyme 2).

As used herein, an "increased effective temperature range for one or more substrates" means that the chimeric enzyme is active across a wider spectrum of temperatures for the same substrate(s) under the same reaction conditions as compared to one or both parental enzymes (i.e., the unmodified first and/or second BGUS enzyme). For example, a parental enzyme 1 may have an effective temperature range of 25–30° C., and a parental enzyme 2 may have an effective temperature range of 30–35° C. A chimeric enzyme composed of a mixture of the SBI domain, TIMB domain and/or Loop 1 domain of enzymes 1 and 2 may have an effective temperature range of 25–35° C. Thus, this effective temperature range of the chimeric enzyme (i.e., 25-35° C.) is greater than the effective pH range of each of the parental enzymes (i.e., greater than 25-30° C. for enzyme 1 and greater than 30-35° C. for enzyme 2).

As used herein, an "increase in enzyme stability" means that the chimeric enzyme is more stable (e.g., better retains its conformational integrity), as compared to one or both parental enzymes (i.e., the unmodified first and/or second BGUS enzymes) under one or more reaction conditions (e.g., reaction conditions that promote denaturation of enzymes), such as temperatures above 37° C. (e.g., 65° C., 100° C.) and/or reducing conditions (e.g., TCEP buffer) and/or denaturing reagents (e.g., urea and guanidine). Additionally or alternatively, an "increase in enzyme stability" can mean that the chimeric enzyme retains its stability (e.g., conformational integrity) across a wider spectrum of temperatures and/or buffer conditions as compared to one or both parental enzymes (i.e., the unmodified first and/or second BGUS enzymes).

In various embodiments, the first and second BGUS enzymes are each from a species independently selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens, Homo sapiens, Lactobacillus brevis, Mus musculus, Parabacteroides sp., Staphylococcus sp.* and *Streptococcus agalactiae*. In one embodiment, the first BGUS enzyme is from *Aspergillus oryzae* and the second BGUS enzyme is from *Aspergillus terreus*. Specific chimeric enzymes and their activities are described in detail in Example 5.

In one embodiment, the chimeric BGUS enzyme comprises an SBI domain from a first BGUS enzyme and a TIMB domain and Loop 1 domain from a second BGUS enzyme. In one embodiment, this chimeric BGUS enzyme is at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 17-24 and 121-137. In another embodiment, this chimeric BGUS enzyme is at least 90% homologous to an amino acid sequence shown in SEQ ID NO: 19 or 121-137. In yet another embodiment, this chimeric BGUS enzyme is at least 95% homologous to an amino acid sequence shown in SEQ ID NO: 19 or 121-137. In yet other embodiment, this chimeric BGUS enzyme is at least 90%, 91%, 92%, 93%, 94%, 95%, 96%, 97%, 98%, 98.5%, 99% or 99.5% homologous to an amino acid sequence shown in SEQ ID NO: 19 or 121-137. In one embodiment, the chimeric BGUS enzyme comprises the amino acid sequence shown in SEQ ID NO: 17-24 or 121-137. In one embodiment, the chimeric BGUS enzyme comprises the amino acid sequence shown in SEQ ID NO: 19 or 121-137. In one embodiment, the chimeric BGUS enzyme comprises the amino acid sequence shown in SEQ ID NO: 19.

In one embodiment, the chimeric BGUS enzyme comprises an SBI domain from a first BGUS enzyme, a TIMB domain from a second BGUS enzyme, and a Loop 1 domain from the first BGUS enzyme. In one embodiment, this chimeric BGUS enzyme is at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 25-30. In another embodiment, this chimeric BGUS enzyme is at least 90% homologous to an amino acid sequence shown in SEQ ID NO: 26. In yet another embodiment, this chimeric BGUS enzyme is at least 95% homologous to an amino acid sequence shown in SEQ ID NO: 26. In yet other embodiment, this chimeric BGUS enzyme is at least 90%, 91%, 92%, 93%, 94%, 95%, 96%, 97%, 98%, 98.5%, 99% or 99.5% homologous to an amino acid sequence shown in SEQ ID NO: 26. In one embodiment, the chimeric BGUS enzyme comprises the amino acid sequence shown in SEQ ID NO: 26.

In one embodiment, the chimeric BGUS enzyme comprises an SBI domain and a TIMB domain from a first BGUS enzyme and a Loop 1 domain from a second BGUS enzyme. In one embodiment, this chimeric BGUS enzyme is at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 31-36. In another embodiment, this chimeric BGUS enzyme is at least 90% homologous to an amino acid sequence shown in SEQ ID NO: 31. In yet another embodiment, this chimeric BGUS enzyme is at least 95% homologous to an amino acid sequence shown in SEQ ID NO: 31. In yet other embodiment, this chimeric BGUS enzyme is at least 90%, 91%, 92%, 93%, 94%, 95%, 96%, 97%, 98%, 98.5%, 99% or 99.5% homologous to an amino acid sequence shown in SEQ ID NO: 31. In one embodiment, the chimeric BGUS enzyme comprises the amino acid sequence shown in SEQ ID NO: 31.

B. Counter-Loop and Loop 1 Swaps

In one aspect, the disclosure provides chimeric BGUS enzymes in which the Counter-Loop (C-Loop) and Loop 1, both of which are located within the TIM-barrel (TIMB) domain, have been swapped between two different BGUS enzymes. Accordingly, in one embodiment, the disclosure provides a chimeric BGUS enzyme, which comprises a TIM-Barrel domain (TIMB domain) comprising a Counter-loop domain and a Loop 1 domain, wherein the chimeric BGUS enzyme comprises:

(a) a TIMB domain from a first BGUS enzyme, a Counter-loop domain from a second BGUS enzyme and a Loop 1 domain from the first BGUS enzyme; or (b) a TIMB domain from a first BGUS enzyme, a Counter-loop domain from the first BGUS enzyme and a Loop 1 domain from a second BGUS enzyme; or (c) a TIMB domain from a first BGUS enzyme, a Counter-loop domain from a second BGUS enzyme and a Loop 1 domain from the second BGUS enzyme.

As discussed herein, for BGUS enzymes, the TIM-barrel domain corresponds to the approximately 310 amino acids at the C-terminus. The C-loop and Loop 1 regions located within the TIMB domain are indicated in FIG. 2 and FIG. 4, wherein FIG. 4 illustrates two possible regions of Loop 1 (one longer and one shorter) for swapping. Approaches for creating the Counter-Loop and Loop 1 swaps are described in detail in Example 6.

In one embodiment, the chimeric enzyme comprises a TIMB domain from a first BGUS enzyme, a Counter-loop domain from a second BGUS enzyme and a Loop 1 domain from the first BGUS enzyme. In this chimeric enzyme, the upstream sugar-binding/Ig-like (SBI) domain can be from the first BGUS enzyme, the second BGUS enzyme or from a different BGUS enzyme. When the SBI domain is from the first BGUS enzyme, then the structure of this chimeric is entirely the first BGUS enzyme except for the Counter-loop domain, which is from the second BGUS enzyme. Such a chimeric enzyme can be created using the first BGUS enzyme as the template and swapping in the C-loop from the second BGUS enzyme by recombinant means as described in Example 6.

In another embodiment, the chimeric enzyme comprises a TIMB domain from a first BGUS enzyme, a Counter-loop domain from the first BGUS enzyme and a Loop 1 domain from a second BGUS enzyme. In this chimeric enzyme, the upstream sugar-binding/Ig-like (SBI) domain can be from the first BGUS enzyme, the second BGUS enzyme or from a different BGUS enzyme. When the SBI domain is from the first BGUS enzyme, then the structure of this chimeric is entirely the first BGUS enzyme except for the Loop 1 domain, which is from the second BGUS enzyme. Such a chimeric enzyme can be created using the first BGUS enzyme as the template and swapping in the Loop 1 from the second BGUS enzyme by recombinant means as described in Example 6.

In another embodiment, the chimeric enzyme comprises a TIMB domain from a first BGUS enzyme, a Counter-loop domain from a second BGUS enzyme and a Loop 1 domain from the second BGUS enzyme. In this chimeric enzyme, the upstream sugar-binding/Ig-like (SBI) domain can be from the first BGUS enzyme, the second BGUS enzyme or from a different BGUS enzyme. When the SBI domain is from the first BGUS enzyme, then the structure of this chimeric is entirely the first BGUS enzyme except for the C-loop and Loop 1 domains, which are from the second BGUS enzyme. Such a chimeric enzyme can be created using the first BGUS enzyme as the template and swapping in the C-loop and Loop 1 domains from the second BGUS enzyme by recombinant means as described in Example 6.

In various embodiments, the chimeric BGUS enzyme exhibits:

(i) an increased level of enzymatic activity for one or more substrates as compared to the first or second BGUS enzyme; or (ii) an increased effective range of substrates catalyzed as compared to the first or second BGUS enzyme; or (iii) an increased effective pH range for one or more substrates as compared to the first or second BGUS enzyme; or (iv) an increased effective temperature range for one or more substrates as compared to the first or second BGUS enzyme; or (v) an increase in enzyme stability as compared to the first or second BGUS enzyme; or (vi) any combination of (i)-(v).

These properties are described further in Subsection 1A above.

In various embodiments, the first and second BGUS enzymes are each from a species independently selected from the group consisting of *Aspergillus oryzae*, *Aspergillus terreus*, *Bacteroides fragilis*, *Bacteroides uniformis*, *Brachyspira murdochii*, *Brachyspira pilosicoli*, *Clostridium perfringens*, *Escherichia coli*, *Eubacterium eligens*, *Homo sapiens*, *Lactobacillus brevis*, *Mus musculus*, *Parabacteroides* sp., *Staphylococcus* sp. and *Streptococcus agalactiae*. In one embodiment, the first BGUS enzyme is from *Brachyspira pilosicoli* and the second BGUS enzyme is from *Eubacterium eligens* or the first BGUS enzyme is from *Eubacterium eligens* and the second BGUS enzyme is from *Brachyspira pilosicoli*.

In one embodiment, this chimeric BGUS enzyme is at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 37-46. In one embodiment, this chimeric BGUS enzyme is at least 90% homologous to an amino acid sequence shown in SEQ ID NO: 40 or 45. In another embodiment, this chimeric BGUS enzyme is at least 95% homologous to an amino acid sequence shown in SEQ ID NO: 40 or 45. In yet another embodiment, this chimeric BGUS enzyme is at least 90%, 91%, 92%, 93%, 94%, 95%, 96%, 97%, 98%, 98.5%, 99% or 99.5% homologous to an amino acid sequence shown in SEQ ID NO: 40 or 45. In yet another embodiment, this chimeric BGUS enzyme comprises the amino acid sequence shown in SEQ ID NO: 40 or 45.

C. Amino Acid Substitutions

In one aspect, the disclosure provides variant BGUS enzymes in which one or more key residues have been substituted with a different amino acid than is present in the parental (template) enzyme. Non-limiting exemplary methods of preparing and screening such variants are described in detail in Example 7. Other suitable methods for preparing single or multiple point mutations within the BGUS enzyme are well established in the art.

In one embodiment, amino acid substitution(s) is made at one or more positions within Variant Site 1, 2 or 3 shown in FIG. 1. Variant BGUS enzymes having single and double point mutations at these residues, and their activities, are described in detail in Examples 8-14.

Accordingly, in one embodiment, the disclosure provides a variant beta-glucuronidase (BGUS) enzyme derived from a parental BGUS enzyme, the variant BGUS enzyme comprising an amino acid sequence at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 1-46 and 138 and comprising at least one amino acid substitution, as compared to the parental BGUS enzyme, at at least one amino acid position corresponding to F294, T295, I450, Q451, A452 and/or G563 of SEQ ID NO: 5, wherein the variant BGUS enzyme exhibits:

(i) an increased level of enzymatic activity for one or more substrates as compared to the parental BGUS enzyme; or (ii) an increased effective range of substrates catalyzed as compared to the parental BGUS enzyme; or (iii) an increased effective pH range for one or more substrates as compared to the parental BGUS enzyme; or (iv) an increased effective temperature range for one or more substrates as compared to the parental BGUS enzyme; or (v) an increase in enzyme stability as compared to the parental BGUS enzyme; or (vi) any combination of (i)-(v).

These properties are described further in Subsection 1A above.

In one embodiment, the variant BGUS enzyme is at least 90% homologous to an amino acid sequence shown in SEQ ID NOs: 1-46 and 138. In another embodiment, the variant BGUS enzyme is at least 95% homologous to an amino acid sequence shown in SEQ ID Nos: 1-46 and 138. In another embodiment, the variant BGUS enzyme is at least 90%, 91%, 92%, 93%, 94%, 95%, 96%, 97%, 98%, 98.5%, 99% or 99.5% homologous to an amino acid sequence shown in SEQ ID NOs: 1-46 and 138.

In various embodiments of the point variants, the parental BGUS enzyme is from a species selected from the group consisting of *Aspergillus oryzae, Aspergillus terreus, Bacteroides fragilis, Bacteroides uniformis, Brachyspira murdochii, Brachyspira pilosicoli, Clostridium perfringens, Escherichia coli, Eubacterium eligens, Homo sapiens, Lactobacillus brevis, Mus musculus, Parabacteroides* sp., *Staphylococcus* sp. and *Streptococcus agalactiae*.

In one embodiment, the variant BGUS enzyme comprises an amino acid substitution, as compared to the parental BGUS enzyme, at an amino acid position corresponding to F294 of SEQ ID NO: 5. In specific embodiments, this variant BGUS enzyme comprises an amino acid sequence selected from the group consisting of the amino acid sequences shown in SEQ ID NOs: 47-54 (corresponding to BpF294A, BpF294I, BpF294V, BpF294Y, BpF294L, BpF294W, EeF303W and EeF303S, respectively).

In another embodiment, the variant BGUS enzyme comprises an amino acid substitution, as compared to the parental BGUS enzyme, at an amino acid position corresponding to T295 of SEQ ID NO: 5. In specific embodiments, this variant BGUS enzyme comprises an amino acid sequence selected from the group consisting of the amino acid sequences shown in SEQ ID NOs: 55-63, (corresponding to BpT295A, BpT295C, BpT295F BpT295I, BpT295K, BpT295S, BpT295V, EeK304A and EeK304V, respectively).

In another embodiment, the variant BGUS enzyme comprises an amino acid substitution, as compared to the parental BGUS enzyme, at an amino acid position corresponding to I450 of SEQ ID NO: 5. In specific embodiments, this variant BGUS enzyme comprises an amino acid sequence selected from the group consisting of the amino acid sequences shown in SEQ ID NOs: 64-76 and 121-124 (corresponding to BpI450F, BpI450K. BpI450L, BpI450M. BpI450Q. BpI450D, BpI450V, EeV459F. EeV459L, EeV459W, EeV459C, EeV459G, EeV459E, Rxn3Y447L, Rxn3Y447P, Rxn3Y447I and Rxn3Y447Q, respectively).

In another embodiment, the variant BGUS enzyme comprises an amino acid substitution, as compared to the parental BGUS enzyme, at an amino acid position corresponding to Q451 of SEQ ID NO: 5. In specific embodiments, this variant BGUS enzyme comprises an amino acid sequence selected from the group consisting of the amino acid sequences shown in SEQ ID NOs: 77-82 and 125-130 (corresponding to BpQ451D, BpQ451E, BpQ451 G, BpQ451 S, BpQ451V, BpQ451K, Rxn3G448E, Rxn3G448K, Rxn3G448F, Rxn3G448L, Rxn3G448C and Rxn3G448W, respectively).

In another embodiment, the variant BGUS enzyme comprises an amino acid substitution, as compared to the parental BGUS enzyme, at an amino acid position corresponding to A452 of SEQ ID NO: 5. In specific embodiments, this variant comprises an amino acid sequence selected from the group consisting of the amino acid sequences shown in SEQ ID NOs: 83-92 and 131-137 (corresponding to BpA452D, BpA452K, BpA452N, BpA452G, BpA452E, BpA452Q, EeG461A, EeG461H, EeG461N, EeG461S, Rxn3D449Q, Rxn3D449G, Rxn3D449R, Rxn3D449K, Rxn3D449S, Rxn3D449C and Rxn3D449E, respectively.

In another embodiment, the variant BGUS enzyme comprises amino acid substitutions, as compared to the parental BGUS enzyme, at amino acid positions corresponding to F294 and T295 of SEQ ID NO: 5. In specific embodiments, the variant comprises an amino acid sequence selected from the group consisting of the amino acid sequences shown in SEQ ID NOs: 101-106 (corresponding to BpF294Y/T295C, BpF294Y/T295I, BpF294Y/T295V, BpF294Y/T295F, BpF294Y/T295M and BpF294Y/T295K, respectively).

In another embodiment, the variant BGUS enzyme comprises amino acid substitutions, as compared to the parental BGUS enzyme, at amino acid positions corresponding to T295 and I450 of SEQ ID NO: 5. In specific embodiments, the variant comprises an amino acid sequence selected from the group consisting of the amino acid sequences shown in SEQ ID NOs: 107-110 (corresponding to BpT295V/I450L, BpT295V/I450M, BpT295V/I450Y and BpT295V/I450V, respectively).

In another embodiment, the variant BGUS enzyme comprises amino acid substitutions, as compared to the parental BGUS enzyme, at amino acid positions corresponding to I450 and Q451 of SEQ ID NO: 5. In specific embodiments, the variant comprises an amino acid sequence selected from the group consisting of the amino acid sequences shown in SEQ ID NOs: 111 and 112 (corresponding to BpI450M/Q451D and BpI450Q/Q451 D, respectively).

In another embodiment, the variant BGUS enzyme comprises amino acid substitutions, as compared to the parental BGUS enzyme, at amino acid positions corresponding to Q451 and A452 of SEQ ID NO: 5. In specific embodiments, the variant comprises an amino acid sequence selected from the group consisting of the amino acid sequences shown in SEQ ID NOs: 113-117 (corresponding to BpQ451D/A452E, BpQ451D/A452G, BpQ451D/A452Q, BpQ451D/A452S and BpQ451D/A452R, respectively).

In another aspect, the disclosure provides variant BGUS enzymes having one or more cysteine substitutions at key residues. Variant BGUS enzymes having single and double point mutations substituting cysteine at key residues, and their activities, are described in detail in Example 15.

Accordingly, in another embodiment, the disclosure pertains to a variant beta-glucumonidase (BGUS) enzyme derived from a parental BGUS enzyme, the variant BGUS enzyme comprising an amino acid sequence at least 80% (or at least 85%, 90%, 91%, 92%, 93%, 94%, 95%, 96%, 97%, 98%, 98.5%, 99% or 99.5%) homologous to an amino acid sequence shown in SEQ ID NOs: 1-46 and 138, and comprising at least one cysteine substitution, as compared to the parental BGUS enzyme, at at least one amino acid position corresponding to Q8, S73, P489, Q570 or K588 of SEQ ID NO: 10, wherein the variant BGUS enzyme exhibits:

(i) an increased level of enzymatic activity for one or more substrates as compared to the parental BGUS enzyme; or (ii) an increased effective range of substrates catalyzed as compared to the parental BGUS enzyme: or (iii) an increased effective pH range for one or more substrates as compared to the parental BGUS enzyme; or (iv) an increased effective temperature range for one or more substrates as compared to the parental BGUS enzyme; or (v) an increase in enzyme stability as compared to the parental BGUS enzyme; or (vi) any combination of (i)-(v).

These properties are described further in Subsection 1A above.

In specific embodiments, the cysteine-substituted variant BGUS enzyme comprises an amino acid sequence selected from the group consisting of the amino acid sequences shown in SEQ ID NOs: 118-120 (corresponding to EeQ8C/S73C, EeK588C and EeP489C/Q570C, respectively).

D. Combination Variants

In another aspect, the invention pertains to variant BGUS enzymes that contain two or more of the above described modifications, referred to herein as combination variants. For example, a chimeric enzyme as described in Subsection 1A or 1B above can be used as the parental (template) enzyme for introduction of one or more amino acid substitutions as described in Subsection 1C above.

Non-limiting examples of such combination variants include the BGUS enzymes having the amino acid sequences shown in SEQ ID NOs: 99 and 100 (corresponding to Rxn3G560V and Rxn3G560E, respectively, in which the chimeric Rxn3 enzyme also has a point mutation at position G560). Additional non-limiting examples of such combination variants include the BGUS enzymes having the amino acid sequences shown in SEQ ID NOs: 121-124 (corresponding to Rxn3Y447L. Rxn3Y447P. Rxn3Y447I and Rxn3Y447Q, respectively, in which the chimeric Rxn3 enzyme also has a point mutation at position Y447). Additional non-limiting examples of such combination variants include the BGUS enzymes having the amino acid sequences shown in SEQ ID NOs: 125-130 (corresponding to Rxn3G448E, Rxn3G448K, Rxn3G448F, Rxn3G448L, Rxn3G448C and Rxn3G448W, respectively, in which the chimeric Rxn3 enzyme also has a point mutation at position G448). Additional non-limiting examples of such combination variants include the BGUS enzymes having the amino acid sequences shown in SEQ ID NOs: 131-137 (corresponding to Rxn3D449Q, Rxn3D449G, Rxn3D449R, Rxn3D449K, Rxn3D449S, RxnD449C and Rxn3D449E, respectively, in which the chimeric Rxn3 enzyme also has a point mutation at position D449).

Still further, a combination variant can comprise one or more of the modifications described above in Subsections 1A, 1B and/or 1C, and additionally can have a cysteine residue appended at the carboxy terminus. For example, a tripeptide Glycine-Leucine-Cysteine (GLC) can be appended at the carboxy terminus. Combination variants comprising a chimeric enzyme as described in Subsection 1A above and having a GLC tripeptide appended at the carboxy terminus are described in Example 5. Furthermore, BGUS variant having a cysteine residue appended at the carboxy terminus, such as a GLC peptide, have been described in the art (see U.S. Pat. No. 9,920,306).

II. Preparation of Variant Enzymes

The BGUS enzymes of the invention can be prepared using standard recombinant DNA techniques. Exemplary methods for preparing chimeric enzymes or amino acid-substituted variants are described in the Examples, although other methods known in the art for protein mutagenesis by standard recombinant DNA techniques are also suitable. Once a nucleic acid fragment encoding the desired variant BGUS enzyme has been obtained, the fragment can be inserted into a suitable expression vector, transformed into a suitable host cell and the variant protein expressed recombinantly by culturing of the host cell, e.g., as described in Example 1. Suitable DNA constructs, expression vectors and host cells are well established in the art.

Accordingly, in another aspect, the disclosure provides a DNA construct encoding a chimeric or other variant BGUS enzyme of the disclosure, including plasmid constructs. In another aspect, the disclosure provides an expression vector comprising the DNA construct encoding the chimeric or other variant BGUS enzyme, including plasmid expression vectors and viral expression vectors. In another aspect, the disclosure provides a host cell comprising an expression vector encoding the chimeric or other variant BGUS enzyme, including prokaryotic (e.g., bacterial) and eukaryotic (e.g., yeast) host cells. In yet another aspect, the disclosure provides a method of expressing (i.e., producing) the chimeric or other variant BGUS enzymes by culturing the host cells such that the enzyme is expressed. Suitable culture conditions for host cells are well established in the art.

Following recombinant expression of the variant BGUS enzyme, the protein can be purified using standard protein purification techniques, such as those described in Example 2. For example, standard affinity chromatography methods, such as immunoaffinity chromatography using an anti-BGUS antibody or metal ion affinity chromatography using nickel, cobalt or copper resin, can be used. Furthermore, dispersive pipette extraction technology, such as IMC-Stips™, can be used for enzyme purification (e.g., as described in Example 2 and shown in FIG. 5). Recombinant variant enzyme typically exhibits a significantly higher degree of purity than commercially available extracts from abalone, snail or humans. Thus, the recombinant variant enzymes of the disclosure advantageously lack contaminating proteins found in commercially available crude extract preparations, which contaminating proteins could interfere with enzyme activity or efficiency.

III. Formulations

The variant BGUS enzymes of the disclosure can be included in formulations that contain additional substances and/or that are formulated in a particular way. For example, the formulations of the disclosure can be either liquid (aqueous) or lyophilized (freeze-dried). Liquid formulations typically allow for maintenance of enzymatic activity even after cycles of freezing/thawing. Lyophilized formulations typically maintain enzymatic activity over a wide temperature range, including high temperatures. Typically, a formulation comprises the enzyme blend composition and at least one excipient. Non-limiting examples of excipients that can be included in a formulation include water, salts, buffers, sugars and amino acids. Certain BGUS enzyme formulations have been described in the art, such as in PCT Application No. PCT/US2017/14387, the entire contents of which is expressly incorporated herein by reference.

Aqueous and lyophilized formulations can be prepared using methods well established in the art. Typically, an aqueous formulation is prepared by combining the enzymes and the excipient(s) at the desired concentrations. A lyophilized formulation can be made by freeze-drying the aqueous formulation using techniques well established in the art.

In certain embodiments, one or more sugars are used in the formulation. In one embodiment, the sugar is a polyol. In certain embodiments, the sugar(s) used in the formulation is selected from the group consisting of sucrose, sorbitol, xylitol, glycerol, 2-hydroxypropyl-β-cycloxextrin and α-cyclodextrin. In a preferred embodiment, the sugar is sucrose.

In certain embodiments, the sugar is present in the formulation at a concentration of at least 10 mM, or at least 25 mM or at least 50 mM or at least 100 mM. In other embodiments, the sugar is present in the formulation at a concentration of 10-1000 mM, or 25-500 mM or 50 mM-250 mM or 50 mM-500 mM or 50 mM-1000 mM. In other embodiments, the sugar is present in the formulation at a concentration of 50 mM or 75 mM or 100 mM or 200 mM or 250 mM or 300 mM or 400 mM or 500 mM or 600 mM or 700 mM or 750 mM or 800 mM or 900 mM or 1000 mM.

In certain embodiments, one or more amino acids (e.g., beta-alanine, L-histidine) is present in the formulation at a concentration of at least 25 mM or at least 50 mM. In other embodiments, the amino acid(s) is present in the formulation at a concentration of 25-500 mM or 50 mM-250 mM or 50 mM-500 mM. In other embodiments, the amino acid(s) is present in the formulation at a concentration of 25 mM or 30 mM or 40 mM or 50 mM or 75 mM or 100 mM or 200 mM or 250 mM or 300 mM or 400 mM or 500 mM.

In certain embodiments, the variant BGUS enzyme is present in the formulation at a concentration of at least 0.1 mg/mL. In certain embodiments, the variant BGUS enzyme is present in the formulation at a concentration of at least 1 mg/mL or at least 2.5 mg/mL or at least 5 mg/mL or at least 10 mg/mL. In other embodiments, the variant BGUS enzyme is present in the formulation at a concentration of 1-10 mg/mL or 1-5 mg/mL or 2.5-10 mg/mL or 2.5-5 mg/mL. In other embodiments, the variant BGUS enzyme is present in the formulation at a concentration of 1 mg/mL or 2 mg/mL or 3 mg/mL or 4 mg/mL or 5 mg/mL or 6 mg/mL or 7 mg/mL or 8 mg/mL or 9 mg/mL or 10 mg/mL.

In certain embodiments, the variant BGUS enzyme in the formulation has an enzymatic activity of at least 5,000 Units/mL or 5,000 Units/mg, more preferably at least 10,000 Units/mL or 10,000 Units/mg, even more preferably at least 25,000 Units/mL or 25,000 Units/mg and even more preferably 50,000 Units/mL or 50,000 Units/mg. The specific activity of the enzyme in the preparation, in Units/mL or Units/mg, can be determined using a standardized glucuronide linkage hydrolysis assay using phenolphthalein-glucuronide as the substrate. The standardization of the specific activity of BGUS has been well established in the art. Thus, 1 Fishman unit of BGUS activity is defined as an amount of enzyme that liberates 1 µg of phenolphthalein from phenolphthalein-glucuronide in 1 hour. Exemplary standardized assays that can be used to determine the specific activity (in Units/mL or Units/mg) of an enzyme preparation are described in further detail in Example 3. The skilled artisan will appreciate that other protocols for the enzyme assay are also suitable (e.g., such as those described by Sigma Aldrich Chemical Co.).

In one embodiment, the formulation is free of detergents, such as surfactants (e.g., Tween compounds and the like). Since the presence of detergents in a BGUS analysis can interfere with mass spectrometry (MS) analysis, the lack of detergent(s) in the formulation of the invention imparts the advantage that the formulation can be used directly in analysis of biological samples to be assayed by MS.

In one embodiment, the formulation is free of polymers (e.g., synthetic polymers and the like). Since the presence of polymers in a BGUS formulation can interfere with mass spectrometry (MS) analysis, the lack of polymer(s) in the formulation of the invention imparts the advantage that the formulation can be used directly in analysis of biological samples to be assayed by MS.

Packaged formulations, comprising a formulation of the disclosure and a container, are also encompassed. Non-limiting examples of suitable containers for use in a packed formulation include, bottles, tubes, vials, ampules and the like. Preferably, the container is glass or plastic, although other suitable materials are known in the art. Non-limiting examples of suitable instruction media include labels, pamphlets, inserts, and digital media.

IV. Methods of Use

The variant BGUS enzymes of the invention exhibit enhanced properties in their ability to hydrolyze glucuronide linkages as compared to the parental enzymes from which they are derived. Accordingly, the variant enzymes can be used in methods for hydrolysis of gluruonide substrates. The variant enzymes can be used, for example, for clinical purposes, for forensic purposes, for industrial manufacturing purposes or for agricultural purposes. These methods are particularly useful for analyzing bodily samples for the presence of drugs through detection of the glucuronide detoxification products of the drugs, e.g., for clinical or forensic purposes. Additionally, beta-agonists have been used in meat husbandry, since they can promote muscle growth instead of fat growth in animals (see e.g., *J. Animal Sci.* (1998) 76:195-207). Thus, the variant enzyme also can be used for agricultural purposes in detecting beta-agonist residues in meat products.

Thus, in another aspect the invention pertains to a method of hydrolyzing a substrate comprising a glucuronide linkage, the method comprising contacting the substrate with a variant β-glucuronidase enzyme of the disclosure under conditions such that hydrolysis of the glucuronide linkage occurs. Any of the variant enzymes of the invention, including the chimeric enzymes, those having a single amino acid substitution, those having double amino acid substitutions and those having more than one modification (i.e., combination variants) can be used in the method.

In one embodiment, the substrate comprises opiate glucuronides. Non-limiting examples of suitable opiate glucuronide substrates include morphine-3-β-D-glucuronide, morphine-6-β-D-glucuronide, codeine-6-β-D-glucuronide, hydromorphone-3-β-D-glucuronide, oxymorphone-3-β-D-glucuronide, and combinations thereof.

In another embodiment, the substrate comprises benzodiazepine glucuronides. Non-limiting examples of suitable benzodiazepine glucuronide substrates include the glucuronides of oxazepam, lorazepam, temazepam, and alpha-hydroxy-alprazolam.

Other suitable ranges of substrates include the glucuronides of buprenorphine, norbuprenorphine, 11-nor-Δ9-tetrahydrocannabinol-9-carboxylic acid, testosterone, androsterone, tapentadol, cyclobenzaprine, amitriptyline and combinations thereof.

In another embodiment, the substrate catalyzed by the variant BGUS enzyme comprises glucuronidated metabolites of drugs comprising opiates, synthetic opioids, antidepressants and benzodiazepines. In another embodiment, the substrate catalyzed by the variant BGUS enzyme comprises glucuronidated opiates comprising morphine-3-β-D-glucuronide, hydromorphone-3-β-D-glucuronide, oxymorphone-3-β-D-glucuronide, codeine-6-β-D-glucuronide and dihydrocodeine-6-β-D-glucuronide. In another embodiment, the substrate catalyzed by the variant BGUS enzyme comprises glucuronidated opioids comprising buprenorphine glucuronide, norbuprenorphine glucuronide and tapentadol glucuronide. In another embodiment, the substrate catalyzed by the BGUS variant enzyme comprises glucuronidated anti-depressants comprising O-desmethylvenlafaxine glucuronide and amitriptyline-N-β-D-glucuronide. In another embodiment, the substrates catalyzed by the variant BGUS enzyme comprises glucuronidated benzodiazepines comprising temazepam glucuronide, oxazepam glucuronide and lorazepam glucuronide.

In one embodiment, the substrate catalyzed by the BGUS variant enzyme comprises at least one beta-agonist (e.g., for meat product analysis). Non-limiting examples of suitable beta-agonist glucuronidated substrates include clenbuterol, ractopamine and salbutamol.

In yet another embodiment, the substrate catalyzed by the variant BGUS enzyme comprises morphine-3-β-D-glucuronide (MOR), oxymorphone-3-β-D-glucuronide (OMOR), hydromorphone-3-β-D-glucuronide (HMOR), codeine-6-β-D-glucuronide (COD), dihydrocodeine-6-β-D-glucuronide (DCOD), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc), and/or temazepam glucuronide (TEM gluc).

In certain embodiments of the method of hydrolyzing a substrate, one or more particular substrates are used in combination with a particular variant BGUS enzyme that exhibits enhanced enzymatic activity against that particular substrate as compared to the parental BGUS enzyme from which the variant is derived. For example, in one embodiment, the disclosure pertains to a method of hydrolyzing codeine-6-β-D-glucuronide (COD), the method comprising contacting the substrate with a variant BGUS enzyme comprising an amino acid substitution, as compared to the parental BGUS enzyme, at an amino acid position corresponding to Q451 of SEQ ID NO: 5, such that hydrolysis of the glucuronide linkage occurs. In one embodiment of this method, the variant BGUS enzyme comprises the amino acid sequence shown in SEQ ID NO: 76 (BpGUS comprising a Q451D mutation). In another embodiment of this method, the variant BGUS enzyme comprises the amino acid sequence shown in SEQ ID NO: 113 (BpGUS comprising Q451D/A452E mutations). In another embodiment of this method, the variant BGUS enzyme comprises the amino acid sequence shown in SEQ ID NO: 114 (BpGUS comprising Q451D/A452G mutations). In another embodiment of this method, the variant BGUS enzyme comprises the amino acid sequence shown in SEQ ID NO: 115 (BpGUS comprising Q451D/A452Q mutations). In another embodiment of this method, the variant BGUS enzyme comprises the amino acid sequence shown in SEQ ID NO: 116 (BpGUS comprising Q451D/A452S mutations). In another embodiment of this method, the variant BGUS enzyme comprises the amino acid sequence shown in SEQ ID NO: 117 (BpGUS comprising Q451D/A452R mutations).

In another embodiment, the disclosure pertains to a method of hydrolyzing amitriptyline-N-β-D-glucuronide (AMT gluc), the method comprising contacting the substrate with a variant BGUS enzyme comprising an amino acid substitution, as compared to the parental BGUS enzyme, at an amino acid position corresponding to I450 of SEQ ID NO: 5, such that hydrolysis of the glucuronide linkage occurs. In one embodiment of this method, the variant BGUS enzyme comprises the amino acid sequence shown in SEQ ID NO: 64 (BpGUS comprising an I450F mutation). In another embodiment of this method, the variant BGUS enzyme comprises the amino acid sequence shown in SEQ ID NO: 65 (BpGUS comprising an I450K mutation). In another embodiment of this method, the variant BGUS enzyme comprises the amino acid sequence shown in SEQ ID NO: 67 (BpGUS comprising an I450M mutation). In another embodiment of this method, the variant BGUS enzyme comprises the amino acid sequence shown in SEQ ID NO: 68 (BpGUS comprising an I450Q mutation). In another embodiment of this method, the variant BGUS enzyme comprises the amino acid sequence shown in SEQ ID NO: 69 (BpGUS comprising an I450D mutation). In another embodiment of this method, the variant BGUS enzyme comprises the amino acid sequence shown in SEQ ID NO: 71 (EeGUS comprising a V459F mutation). In another embodiment of this method, the variant BGUS enzyme comprises the amino acid sequence shown in SEQ ID NO: 72 (EeGUS comprising a V459L mutation). In another embodiment of this method, the variant BGUS enzyme comprises the amino acid sequence shown in SEQ ID NO: 74 (EeGUS comprising a V459C mutation). In another embodiment of this method, the variant BGUS enzyme comprises the amino acid sequence shown in SEQ ID NO: 75 (EeGUS comprising a V459G mutation).

In another embodiment, the disclosure pertains to a method of hydrolyzing morphine-3-β-D-glucuronide (MOR), the method comprising contacting the substrate with a variant BGUS enzyme comprising an amino acid substitution, as compared to the parental BGUS enzyme, at an amino acid position corresponding to I450 of SEQ ID NO: 5, such that hydrolysis of the glucuronide linkage occurs. In one embodiment of this method, the variant BGUS enzyme comprises the amino acid sequence shown in SEQ ID NO: 64 (BpGUS comprising an I450F mutation). In another embodiment of this method, the variant BGUS enzyme comprises the amino acid sequence shown in SEQ ID NO: 67 (BpGUS comprising an I450M mutation). In another embodiment of this method, the variant BGUS enzyme comprises the amino acid sequence shown in SEQ ID NO: 68 (BpGUS comprising an I450Q mutation).

In one embodiment, the range of substrates is in a sample of blood, urine, tissue or meconium obtained from a subject. The methods of the invention can be used on a variety of different bodily samples. Non-limiting examples of suitable bodily samples include blood, urine, tissue or meconium obtained from a subject. For meat product analysis, the bodily sample can be a meat sample. Bodily samples can be obtained, stored and prepared for analysis using standard methods well established in the art.

Following hydrolysis by the enzyme, the cleavage products in the sample can be analyzed by standard methodologies, such as high performance liquid chromatography (HPLC), gas chromatography (GC) and/or mass spectrometry (MS). Such approaches for analysis of bodily samples for the presence of drugs are well established in the art. For example, a completely automated workflow for the hydrolysis and analysis of urine samples by LC-MS/MS, which can be applied using the variant enzymes of the invention for hydrolysis, is described in Cabrices, O. G. et al., GERSTEL AppNote AN/2014/4-7. Additional liquid chromatography and tandem mass spectrometry (LC-MS/MS) methodologies suitable for use with the invention are described in Sitasuwan et al. (2016) *J. Analytic. Toxicol.* 40:601-607. Methods for detecting beta-agonist residues in meat products using UPLC-MS/MS have also been described (www.waters.com/webassets/cms/library/docs/720004388en.pdf).

The present invention is further illustrated by the following examples, which should not be construed as further limiting. The contents of Sequence Listing, figures and all references, patents and published patent applications cited throughout this application are expressly incorporated herein by reference.

EXAMPLES

Example 1: Gene Synthesis, Cloning, and Protein Expression

Genes for beta-glucuronidase enzymes were synthesized, placed in plasmid expression vectors, and expressed *E. coli* using standard recombinant DNA techniques established in the art. The DNA sequence coding for a protein sequence can be reconstructed from the protein sequence by standard methods well known in the art. For example, amino acid sequences for BGUS enzymes from *Aspergillus oryzae* (AoGUS), *Aspergillus terreus* (AtGUS), *Bacteriodes fragilis* (BfGUS), *Bacteroides uniformis* (BuGUS), *Brachyspira murdochii* (BmGUS), *Brachyspira pilosicoli* (BpGUS), *Clostridium perfringens* (CpGUS), *Escherichia coli* (EcGUS). IMCSzyme® variant *Escherichia coli* K12 (EcE1F), *Eubacterium eligens* (EeGUS), *Homo sapiens* (HsGUS), *Lactobacillus brevis* (LbLR2D), *Mus musculus* (MmGUS), *Parabacteroides* sp. (PmGUS), *Staphylococcus* sp. (StpGUS) and *Streptococcus agalactiae* (SaGUS) are shown in SEQ ID Nos: 1-16, respectively, and can be used to design appropriate DNA sequences coding for the enzymes.

It is noted that the AoGUS amino acid sequence shown in SEQ ID NO: 1 contains a G600S substitution at residue 600 as compared to the wild-type AoGUS amino acid sequence, which is shown in SEQ ID NO: 138. This substitution was made to introduce a restriction site for cloning purposes at the C-terminus of the sequence (as shown in FIG. 3) without affecting the enzymatic function of the AoGUS enzyme. Thus, to make variants that use an AoGUS enzyme as a parental enzyme (e.g., for making a chimeric enzyme and/or an amino acid-substituted variant comprising AoGUS sequences) either SEQ ID NO: 1 or SEQ ID NO: 138 is a suitable parental enzyme.

FIG. 1 show the amino acid sequence alignment for the EeGUS, AoGUS, Rxn3, AtGUS, EcE1F, BpGUS, BmGUS, CpGUS, StpGUS, LbLR2D, SaGUS, HsGUS, BfGUS, PmGUS and BuGUS enzymes.

These DNA sequences can be codon optimized for the organism in which they are to be expressed, and linked to appropriate regulatory sequences that enable transcription and translation of the gene and enzyme product. The sequence may include protein sequences known to those skilled in the art that facilitate purification to near homogeneity (Hochuli et al. (1988) *Nature Biotech.* 6:1321-1325). A non-limiting example is the His$_6$-tag, six histidine residues in a row (SEQ ID NO: 139), usually attached to either the N-terminal or C-terminal of an enzyme, which enables specific purification on chromatography resins containing divalent metal cations, such as nickel, cobalt, copper, or zinc.

Typically, the enzyme-encoding DNA sequence is synthesized with consideration for the codon bias of the expression host, an approach also well established in the art (Maloy et al. (1996) *Cold Spring Harbor Lab. Press*; Gouy and Gautier (1982) *Nucleic Acids Res.* 10:22). Using such methods, genes for EcE1F, AoGUS, AtGUS, BpGUS and EeGUS were synthesized with a codon bias compatible for expression in *Escherichia coli* host cells. Using standard molecular biology techniques, the genes were assembled in plasmid vectors under the control of an inducible promoter and expressed in a bacterial strain supportive of the construct. Enzymes were expressed intracellularly, the cells were lysed by a combination of physical and chemical means, and the lysates clarified by centrifugation. The lysates were then adjusted with buffer compatible with subsequent purification steps.

Example 2: Protein Purification of BGUS Enzymes

Following recombinant expression, the BGUS enzymes, chimeras and variants described in the Examples were purified by standard immobilized metal affinity chromatography (IMAC) techniques known to those skilled in the art, either on an AKTÄ™ Pure FPLC or with IMCStips tip technologies. Protein elution was monitored by absorbance at 280 nm, protein purity was evaluated by SDS-PAGE (Laemmli (1970) *Nature* 227:680-685), and protein concentration in pure fractions was determined by Bradford protein assay (Bradford (1976) *Anal. Biochem.* 72:248-254). The SDS-PAGE shown in FIG. 5 revealed purified protein bands of the expected molecular weights, demonstrating effective purification of the recombinant enzymes. Typically a 4-20% gradient SDS-PAGE was used to determine protein purity and about 1.0 µg of protein was used. Protein purity was assessed by using ImageQuantTL 8.1 Software.

Example 3: pH Optima and Enzymatic Activity Measurements Using Various Substrates Activity of recombinant BGUS enzymes was measured, at two or more pH, using the substrate phenolphthalein-β-D-glucuronide (PTGlcU), a standard substrate for monitoring and reporting BGUS activity (Talalay et al. (1946) *J. Biol. Chem.* 166:757-72). The pH profile for some of the chimeras and variants was determined using a buffer system described in the art (Ellis and Morrison (1982) *Methods Enzymol.* 87:405-426), with phenolphthalein-β-D-glucuronide as the substrate. All enzymes were tested with 1.0 mM PTGlcU in 10% ethanol. For set up, 25 µL of enzyme and 25 µL of 1.0 mM PTGlcU were mixed in a 96-well microtiter plate at room temperature, and the reactions were stopped by addition of 150 µL 0.2 M glycine, pH 10.4. The buffer pH range tested was from pH 4.5-8.0. Thirty minutes after stopping the reaction, the absorbance of each well was read at 540 nm.

Additionally, activity of recombinant BGUS enzymes was measured, at two or more pH, using the substrate 4-methylumbelliferyl-β-D-glucuronide (4MUG). Enzymes were tested with 1.0 mM 4MUG in 10% ethanol. For set up, 25 µL of enzyme and 25 µL of 1.0 mM 4MUG were mixed in a 96-well microtiter plate at room temperature, and the reactions were stopped by addition of 150 µL 0.2 M glycine, pH 10.4. Product of 4MUG was measured by excitation wavelength at 365 nm and emission wavelength at 455 nm.

Additionally, activity of recombinant BGUS enzymes was measured, at two or more pH, using the substrate fluorescein-di-β-D-glucuronide (FDGlcU). Enzymes were tested with 170 µM FDGlcU in 5% methanol. For set up, 25 µL of enzyme and 25 µL of 170 µM FDGlcU were mixed in a 96-well microtiter plate at room temperature, and the reactions were stopped by addition of 150 μL 0.2 M glycine, pH 10.4. Product of FDGlcU was measured by excitation at 490 nm and emission at 514 nm.

Example 4: Liquid Chromatography-Mass Spec and Drug Glucuronides

In this example, liquid chromatography-Mass Spec (LC-MS) was used to measure the activity of BGUS chimeras and variants on various opiate and opioid drug glucuronides. Each recombinant beta-glucuronidase was used to deconjugate up to fourteen glucuronidated drugs frequently tested in urine drug-testing applications. The substrates represent a wide variety of drug classes, such as opiates, synthetic opioids, benzodiazepines, and anti-depressants. The substrates included morphine-3-β-D-glucuronide (MOR), oxymorphone-3-β-D-glucuronide (OMOR), hydromorphone-3-β-D-glucuronide (HMOR), codeine-6-β-D-glucuronide (COD), dihydrocodeine-6-β-D-glucuronide (DCOD), buprenorphine-3-β-D-glucuronide (BUP gluc), norbuprenorphine-3-β-D-glucuronide (NBUP gluc), tapentadol glucuronide (TAP gluc), O-desmethyltramadol glucuronide (ODT gluc), O-desmethylvenlafaxine glucuronide (ODV gluc), amitriptyline-N-β-D-glucuronide (AMT gluc), oxazepem glucuronide (OXZ gluc), lorazepam glucuronide (LOR gluc) or temazepam glucuronide (TEM gluc). The substrates were fortified in synthetic urine at a concentration equivalent to 500 ng/mL when liberated.

The hydrolysis buffer used was 0.2 M sodium acetate, pH 5.5. The internal standard solution was prepared at 1.0 μg/mL of each deuterated drug standard in methanol. 50 μL of urine containing the substrates was mixed with 150 μL of hydrolysis buffer, 20 μL enzyme solution, and 10 μL internal standard solution. The incubations were performed at 23° C. for various times, depending on the chimeras or variants being tested. Samples were extracted using dispersive pipette extraction tips with WAX/RP resins as described in the art. Samples were eluted twice, each in 200 μL of acetonitrile with 1% formic acid. Prior to LC-MS/MS analysis, samples were dried down to 100 μL and diluted with 700 μL of water.

Ultra-performance liquid chromatography was performed on a Thermo-Scientific™ Vanquish™ UHPLC system using a Phenomenex Kinetex® Phenyl-Hexyl 100 Å column (4.6× 50 mm, 2.6 μm). The column was heated to 40° C. with a gradient elution with a flow rate of 0.6 mL/min. Mobile phase A consisted of 0.1% formic acid in ultrapure water and mobile phase B consisted of 0.1% formic acid in acetonitrile. The system was equilibrated in 95% A for the first 0.5 minutes and the gradient consisted of 5-95% B from 0.5-3.0 minutes and re-equilibrated at initial conditions from 4.0-6.0 minutes. The liquid chromatography (LC) system was connected to a Thermo-Scientific™ Endura™ Triple Quadrupole mass spectrometer with an electrospray ionization source, operated in positive mode. Detection was performed by multiple reaction monitoring (MRM) analysis of the most intense transitions originating from the protonated molecular ion [M+1] of each analyte. The aglycone species was quantified and enzyme activity was expressed as pmol·min$^{-1}$·mg$^{-1}$.

Data were plotted as significance (negative logarithm base 10 of p-value) versus change in activity (logarithm base 2 change in activity relative to template). A horizontal dashed line at the logarithm base 10 of 0.05 is used to distinguish data is that has a significant change, i.e. the p-value<0.05; any data plotted above this line are considered significant.

Example 5: Chimeric BGUS Enzymes Having Sugar-Binding/Ig-like Domain, TIM-Barrel Domain and/or Loop 1 Swaps In this example, chimeric BGUS enzymes were prepared in which domains were swapped between AoGUS, AtGUS and/or EcE1F by using DNA restriction enzyme cloning techniques, plasmid DNA expression, DNA purification, and DNA fragment ligation known by those skilled in the art. Fusion sites for domain-swapping were determined by considering the amino acid sequence alignments and crystal structures for AoGUS and EcGUS (PDB codes: 4JHZ and 5C70, respectively). Also, the DNA sequences were engineered to include restriction enzyme DNA sequences at the fusion sites for swapping (see FIG. 3). Domains include the sugar-binding domain, the immunoglobulin-like domain, and the TIM-barrel domain. The sugar-binding and immunoglobulin domains were often exchanged as a pair between AoGUS, AtGUS, and EcE1F, using Restriction Sites 1 and 2 as shown in FIG. 3 to generate chimeras referred to herein as "Rxn" chimeras, wherein the N-terminal portion of the Rxn chimera comprises the sugar-binding/immunoglobulin domains from one BGUS enzyme and the C-terminal portion of the Rxn chimera comprised the TIM-Barrel domain from a second BGUS enzyme. Furthermore, Loop 1 of AoGUS, AtGUS, and/or EcE1F, located within the TIM-Barrel domain, was also swapped between them to generate chimeras referred to herein as "Save" and "L" chimeras, in addition to domain-swapping, by using the combinations of Restriction Site 2 and Loop Site B or Loop Site A and Loop Site B as shown in FIG. 3. Also, the C-terminal residues GLC were swapped into AoGUS and AtGUS using Restriction Site 3 and Restriction Site 4 shown in FIG. 3. All DNA sequences were confirmed by using DNA sequencing techniques known to those skilled in the art.

A summary of the structure of the panel of Rxn, Save and L chimeras is shown below in Table 1:

TABLE 1

Chimeras of AoGUS, AtGUS, and EcE1F.

| Chimera | Domain | | | C-Terminal |
| | SB/IgG-like | TIM-Barrel | Loop1 | GLC residues |
| --- | --- | --- | --- | --- |
| Rxn1 | AtGUS | AoGUS | AoGUS | No |
| Rxn2 | AtGUS | EcE1F | EcE1F | No |
| Rxn3 | AoGUS | AtGUS | AtGUS | No |
| Rxn4 | AtGUS | EcE1F | EcE1F | No |
| Rxn5 | AoGUS | EcE1F | EcE1F | Yes |
| Rxn8 | AtGUS | EcE1F | EcE1F | Yes |
| Rxn9 | EcE1F | AoGUS | AoGUS | Yes |
| Rxn10 | EcE1F | AtGUS | AtGUS | Yes |
| Save1 | AtGUS | AoGUS | AtGUS | No |
| Save3 | AoGUS | AtGUS | AoGUS | No |
| Save4 | AtGUS | EcE1F | AtGUS | No |
| Save5 | AoGUS | EcE1F | AoGUS | Yes |
| Save9 | EcE1F | AoGUS | EcE1F | Yes |
| Save10 | EcE1F | AtGUS | EcE1F | Yes |
| L1 | AoGUS | AoGUS | AtGUS | No |
| L2 | AoGUS | AoGUS | EcE1F | No |
| L3 | AtGUS | AtGUS | AoGUS | No |
| L4 | AtGUS | AtGUS | EcE1F | No |
| L5 | EcE1F | EcE1F | AoGUS | Yes |
| L6 | EcE1F | EcE1F | AtGUS | Yes |

The amino acid sequences of the Rxn1, Rxn2, Rxn3, Rxn4, Rxn5, Rxn8, Rxn9 and Rxn10 chimeras are shown in SEQ ID NOs: 17-24, respectively. The amino acid sequences of the Save1, Save3. Save4, Save5, Save9 and Save10 chimeras are shown in SEQ ID NOs: 25-30, respectively. The amino acid sequences of the L1, L2, L3, L4, L5 and L6 chimeras are shown in SEQ ID NOs: 31-36, respectively.

Figure 6:
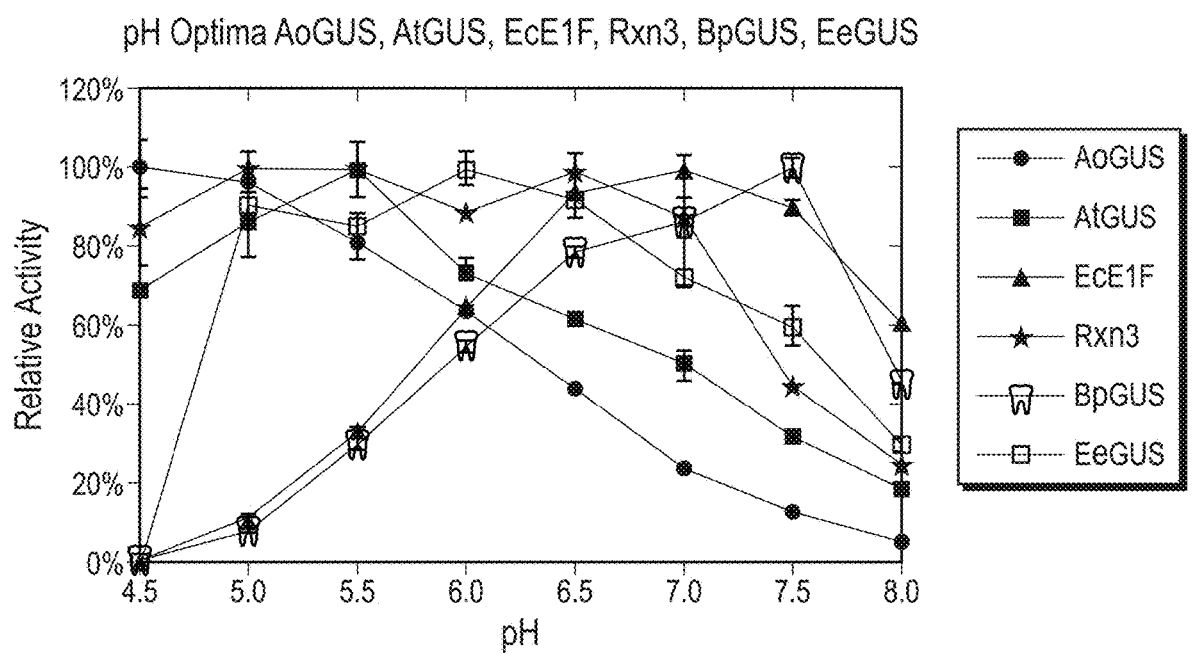
FIG. 6 is a graph showing the pH optima of the AoGUS, AtGUS, EcE1F, Rxn3, BpGUS and EeGUS enzymes.

To study the activity of the chimeric enzymes, in a first series of experiments, the pH range of the chimeras versus the parental enzymes was examined, as described in Example 3. The results for the Rxn3 chimera are shown in FIG. 6 and summarized below in Table 2, which shows the optimum pH range (range in which enzyme maintains 80% or greater activity):

TABLE 2

Optimum pH Range of Rxn3 Chimera versus Parental Enzymes

| BGUS Enzyme | Optimum pH Range ( >80% activity) |
| --- | --- |
| AoGUS | pH 4.5-5.5 |
| AtGUS | pH 5.0-5.5 |
| EcE1F | pH 6.5-7.5 |
| Rxn3 | pH 4.5-7.0 |

The data summarized in Table 2 demonstrates that the Rxn3 chimera (composed of the sugar binding/Ig-like domains of AoGUS and the TIM-Barrel/Loop 1 of AtGUS) has a broader optimum pH range (pH 4.5-7.0) than either the AoGUS parental enzyme (pH 4.5-5.5) or the AtGUS parental enzyme (pH 5.0-5.5).

Additionally, the enzymatic activity of the panel of chimeras was tested using two different substrates, phenolphthalein-β-D-glucuronide (PTGlcU) and 4-methylumbelliferyl-β-D-glucuronide (4MUG) as described in Example 3.

Figure 7:
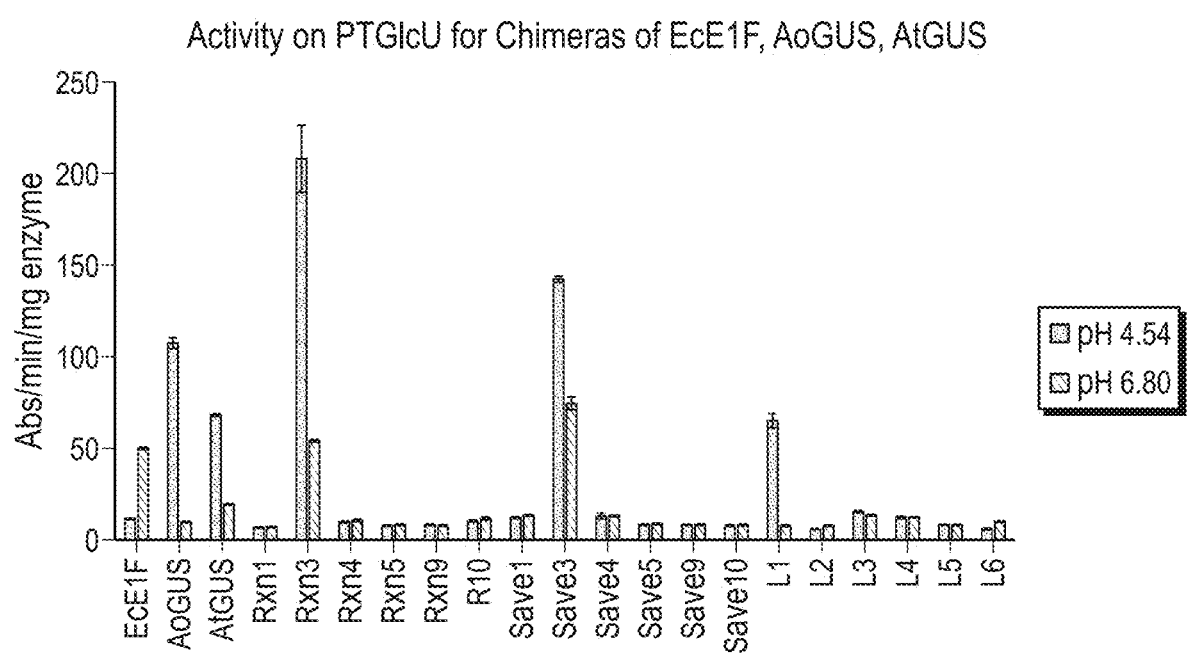
FIG. 7 is a bar graph showing the enzymatic activity of the Rxn, Save and L chimeric enzymes on the PTGlcU substrate.

The results for PTGlcU are shown in FIG. 7. The results in FIG. 7 demonstrate that the Rxn3 chimera and the Save3 chimera (composed of the sugar binding/Ig-like domains of AoGUS, the TIM-Barrel domain of AtGUS and the Loop 1 domain of AoGUS) each exhibit higher enzymatic activity against the PTGlcU substrate than either the AoGUS parental enzyme or the AtGUS parental enzyme at both pH 4.54 and pH 6.80.

Figure 8:
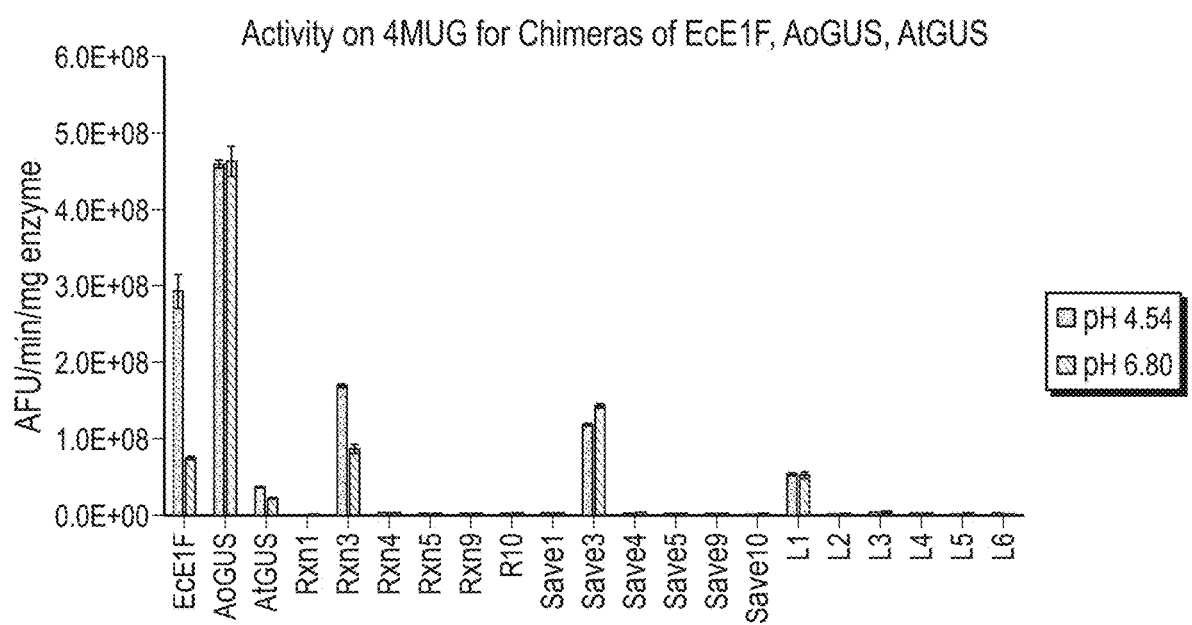
FIG. 8 is a bar graph showing the enzymatic activity of the Rxn, Save and L chimeric enzymes on the 4MUG substrate.

The results for 4MUG are shown in FIG. 8. The results in FIG. 8 demonstrate that the Rxn3 chimera, the Save3 chimera and the L chimera (composed of the sugar binding/Ig-like domain and TIM-Barrel domain of AoGUS and the Loop 1 domain of AtGUS) each exhibited higher enzymatic activity against the 4MUG substrate than the AtGUS parental enzyme at both pH 4.54 and pH 6.80.

In summary, this example demonstrates chimeric enzymes comprising various swaps of the sugar binding/Ig-like domain, TIM-Barrel domain and Loop 1 domain from two different BGUS parental enzymes that exhibited an increased effective pH range and/or increased enzymatic activity against a substrate as compared to either or both of the parental enzymes from which the chimera was derived.

Example 6: Chimeric BGUS Enzymes Having C-Loop and Loop 1 Swaps

In this example, the C-loop, Loop 1, or both were swapped between BpGUS and EeGUS using either restriction-free cloning (Chen et al. (2000) BioTechniques. 28:498-500) or exponential mega-priming polymerase chain reaction (PCR) (Ulrich et al. (2012) PLoS ONE. 7:e53360). The residue lengths of Loop 1 and C-loop to be swapped were determined by using amino acid sequence alignments and by observing predicted crystal structures of BpGUS and EeGUS created by the online software SWISS-MODEL (Waterhouse et al. (2018) Nucleic Acids Res. 46(W1):W296-W303; Bienert et al. (2017) Nucleic Acid Res. 45:D313-D319; Guex et al. (2009) Electrophoresis 30:S162-S173; Benkert et al. (2011) Bioinformatics 27:343-350; Bertoni et al. (2017) Sci. Reports 7). Furthermore, residues for Loop 1 were chosen based on comparisons of flexibility and homology to known BGUS crystal structures. The length of residues swapped for Loop 1 between BpGUS and EeGUS was varied. FIG. 4 shows the C-loop region and the two different Loop 1 swap regions (Loop 1 Swap 1 and Loop 1 Swap 2) of differing lengths that were used to create the chimeras. Ten chimeras of BpGUS and EeGUS were produced, having the structures set forth in Table 3 below. All DNA sequences were confirmed by sequencing.

TABLE 3

BpGUS and EeGUS chimeras for Counter-loop and Loop 1 swaps.

| Chimera | Template | Counter-loop | Loop 1 (amino acid length) |
| --- | --- | --- | --- |
| BpChimera1 | BpGUS | EeGUS | BpGUS (template) |
| BpChimera2 | BpGUS | BpGUS | EeGUS (21 residues) |
| BpChimera3 | BpGUS | EeGUS | EeGUS (21 residues) |
| BpChimera4 | BpGUS | BpGUS | EeGUS (10 residues) |
| BpChimera5 | BpGUS | EeGUS | EeGUS (10 residues) |
| EeChimera1 | EeGUS | BpGUS | EeGUS (template) |
| EeChimera2 | EeGUS | EeGUS | BpGUS (21 residues) |
| EeChimera3 | EeGUS | BpGUS | BpGUS (21 residues) |
| EeChimera4 | EeGUS | EeGUS | BpGUS (10 residues) |
| EeChimera5 | EeGUS | BpGUS | BpGUS (10 residues) |

The amino acid sequences of the BpChimera1, BpChimera2, BpChimera3, BpChimera4 and BpChimera5 chimeras are shown in SEQ ID NOs: 37-41, respectively. The amino acid sequences of the EeChimera1, EeChimera2, EeChimera3, EeChimera4 and EeChimera5 chimeras are shown in SEQ ID NOs: 42-46, respectively.

Figure 9:
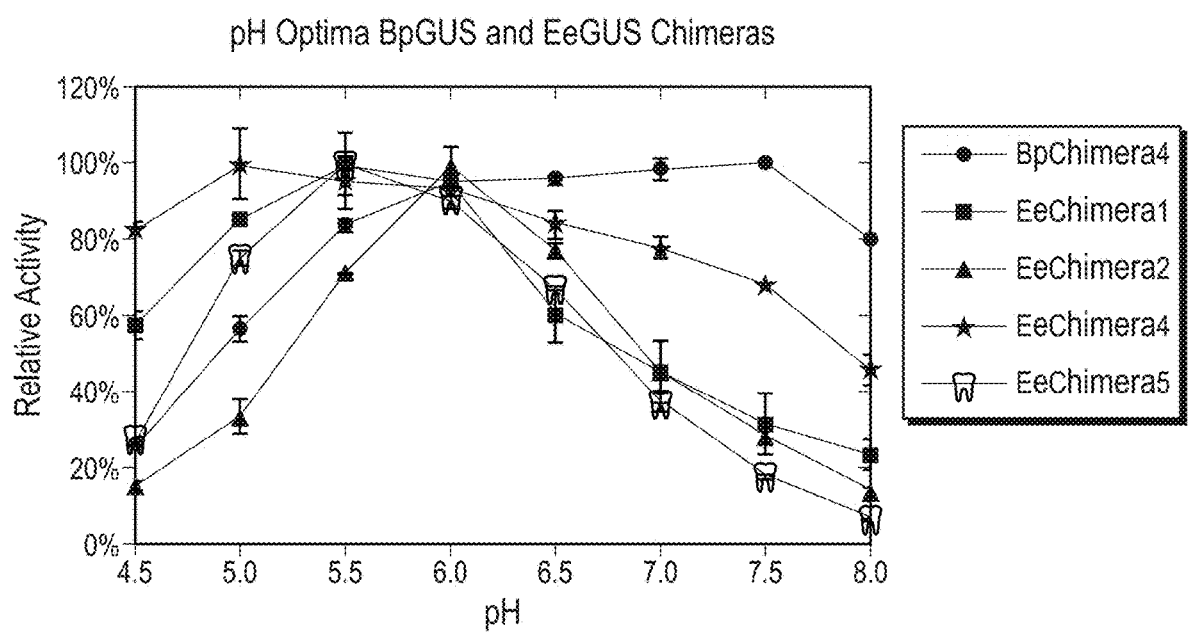
FIG. 9 is a graph showing the pH optima of the BpGUS and EeGUS chimeric enzymes.

To study the activity of the chimeric enzymes, in a first series of experiments, the pH range of the chimeras versus the parental enzymes was examined, as described in Example 3. The results for the BpChimera4, EeChimera1, EeChimera2, EeChimera4 and EeChimera5 chimeric enzymes are shown in FIG. 9. The pH optima for certain BpChimera and EeChimera chimeric enzymes as compared to the parental BpGUS and EeGUS enzymes are summarized below in Table 4, which shows the optimum pH range (range in which enzyme maintains 80% or greater activity):

TABLE 4

Optimum pH Range of BpChimera and EeChimera versus Parental Enzymes

| BGUS Enzyme | Optimum pH Range ( >80% activity) |
| --- | --- |
| BpGUS | pH 7.0-7.5 |
| EeGUS | pH 5.0-6.5 |
| BpChimera4 | pH 5.5-8.0 |
| EeChimera1 | pH 5.0-6.0 |
| EeChimera2 | pH 6.0 |
| EeChimera4 | pH 4.5-6.5 |
| EeChimera5 | pH 5.5-6.0 |

The data summarized in Table 4 demonstrates that the BpChimera4 chimera (composed of the 10 amino acid Loop 1 of EeGUS swapped into BpGUS) has a broader optimum pH range (pH 5.5-8.0) than either the BpGUS parental enzyme (pH 7.0-7.5) or the EeGUS parental enzyme (pH 5.0-6.5). Moreover, the EeChimera4 chimera (composed of the 10 amino acid Loop 1 of BpGUS swapped into EeGUS) has a broader pH range at the lower end of the pH spectrum (pH 4.5-6.5) than either the BpGUS parental enzyme (pH 7.0-7.5) or the EeGUS parental enzyme (pH 5.0-6.5).

Figure 10:
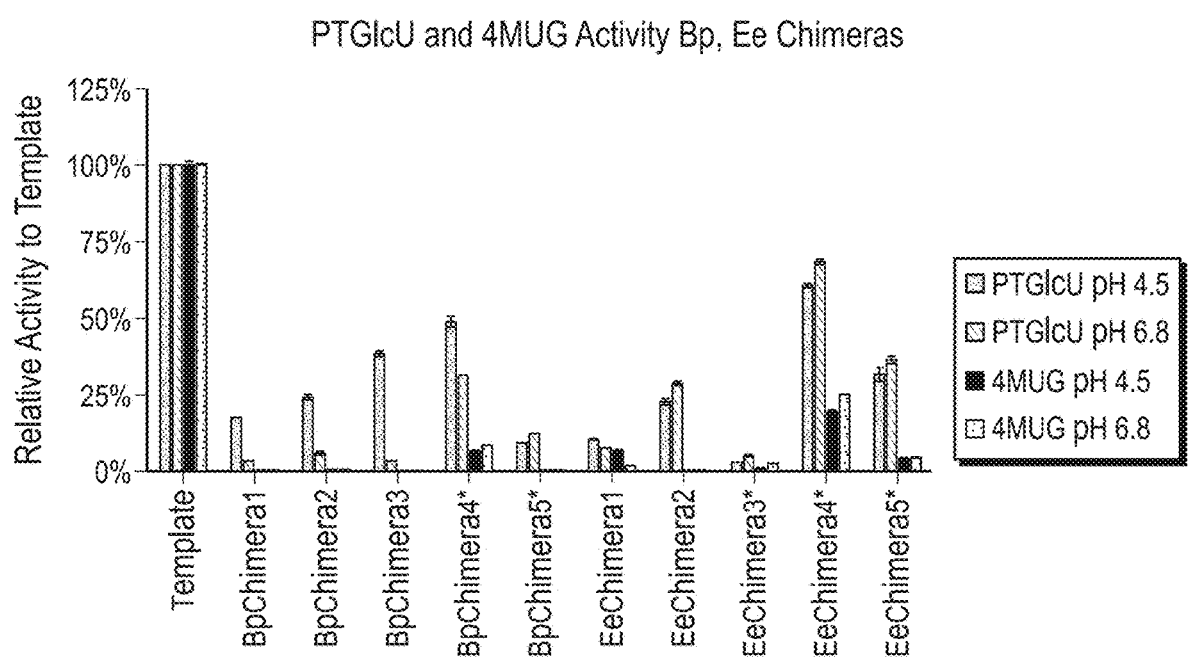
FIG. 10 is a bar graph showing the enzymatic activity of the BpGUS and EeGUS chimeric enzymes on the PTGlcU and 4MUG substrates. The asterisk (*) on certain chimeras indicates the reactions were performed at pH 5.5 and 7.0 for both substrates.

Additionally, the enzymatic activity of the panel of chimeras was tested using two different substrates, phenolphthalein-β-D-glucuronide (PTGlcU) and 4-methylumbelliferyl-β-D-glucuronide (4MUG), as described in Example 3. The results are shown in FIG. 10, which demonstrates that the chimeric enzymes did not exhibit enhanced activity against PTGlcU or 4MUG as compared to the parental enzymes (referred to as Template in FIG. 10).

Figure 11:
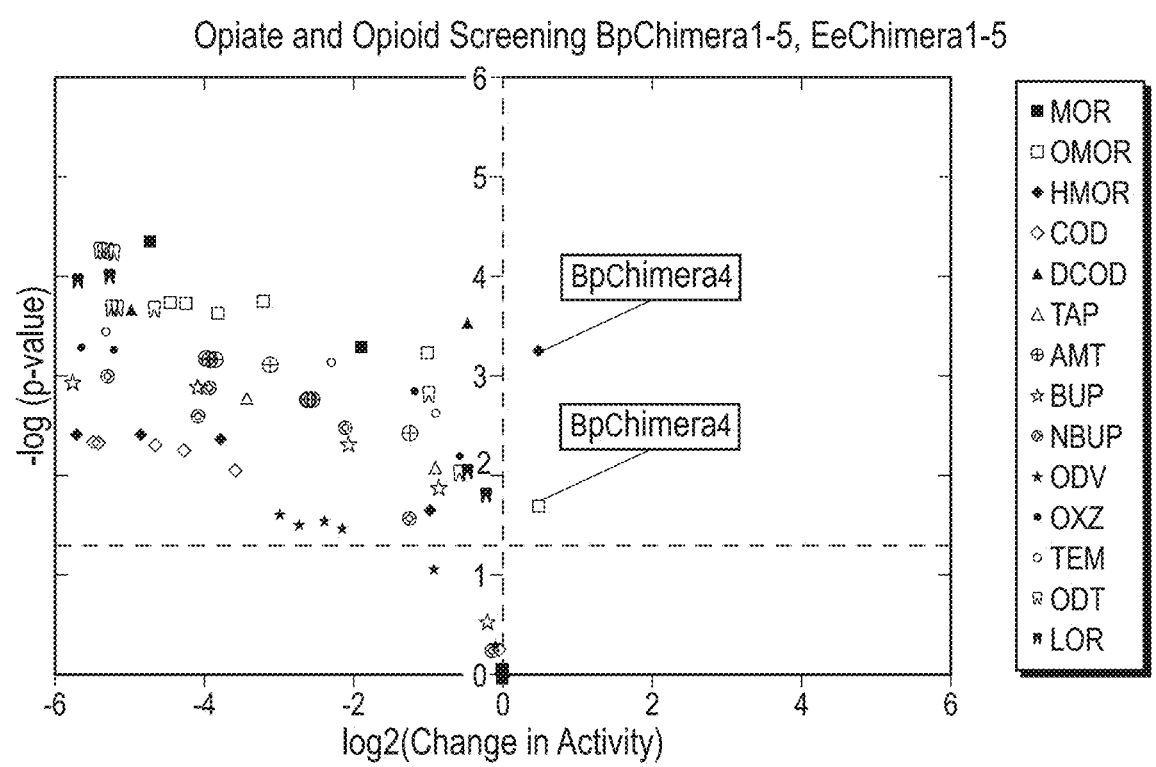
FIG. 11 is a graph showing the significant enzymatic activity of the BpChimera1-5 and EeChimera1-5 chimeric enzymes on a panel of opiate and opioid substrates.

The enzymatic activity of the panel of chimeras also was tested using a panel of opiate and opioid substrates, as described in Example 4. The results for the panel of opiates/opioids are shown in FIG. 11. The results in FIG. 11 demonstrate that the BpChimera4 chimera exhibited enhanced enzymatic activity against the HMOR and OMOR substrates as compared to the parental (template) enzymes.

In summary, this example demonstrates chimeric enzymes comprising various swaps of the C-Loop and Loop 1 domain from two different BGUS parental enzymes that exhibited an increased effective pH range and/or increased enzymatic activity against a substrate as compared to either or both of the parental enzymes from which the chimera was derived.

Example 7: Mutagenesis of Key Residues in BGUS

In this example, key residues within various BGUS enzymes were selected for site-saturation mutagenesis. This is a method whereby all possible amino acid substitutions are made at a single residue site using degenerate oligonucleotides. Oligonucleotides were designed so that only one codon was used for each possible amino acid (Pines et al. (2014) *ACS Synth. Bio.* 4:604-614). Variants were produced from the following templates (i.e., parental enzymes) at the residues indicated: AoGUS (G560); AtGUS (G562); Rxn3 (G560, Y447, G448, D449); BpGUS (G563, F294, T295, I450, Q451, A452); EeGUS (S571, F303, K304, V459, Q460, G461). These key residue positions for mutagenesis are highlighted as Variant Sites 1, 2 and 3 in the alignment of 15 BGUS enzymes shown in FIG. 1.

In addition, key residues in EeGUS were mutated to cysteine in an effort to improve enzyme function and stability: Q8C, S73C, Q8C/S73C, L53C, K326C, L53C/K326C, H526C, K588C, H526C/K588C, P489C, Q570C, P489C/Q570C.

Over 90 clones from each site-saturation mutagenesis library of each key residue were screened for activity to ensure that every possible amino acid was tested at each site. At this level of coverage, statistical calculations predict a >99% chance that each amino acid would be screened at least once. Active clones were selected by in vivo assay using the fluorescent substrates 4-methylumbelliferyl-β-D-glucuronide (4MUG) or fluorescein-di-β-D-glucuronide (FDGlcU). This assay was performed by growing the clones for about 16 hours at 37° C. in a 96-well plate where each well contains the appropriate anti-biotic and 150 μL of LB with shaking at 300 RPM. Next, 150 μL of media containing IPTG (0.2 mM), glucose (1.2%), and glycerol (0.8%) was added to the 96-well plate and the cells incubated for 3-4 hours at 37° C. and 300 RPM. After expression induction, the optical density ($OD_{600}$) of the cells was determined by measuring the absorbance at 600 nm. The activity assay was performed by mixing 25 μL of cells with 25 μL of substrate, incubating the reactions at room temperature for 5 minutes, then stopping the reactions with the addition of 150 μL 0.2 M glycine, pH 10.4. The stock concentration of 4MUG was 1.0 mM in 10% EtOH with either 100 mM potassium acetate (pH 4.5) or potassium phosphate (pH 6.8), and the stock concentration of FDGlcU was 170 μM in 5% MeOH with either 100 mM potassium acetate (pH 4.5) or potassium phosphate (pH 6.8). The pH of the buffer used was chosen based on the pH optimum of the variant template. The product of 4MUG was measured by excitation at 365 nm and emission at 445 nm, and the product of FDGlcU was measured by excitation at 490 nm and emission at 514 nm. Activity was calculated as arbitrary fluorescent units (AFU) per minute per OD. The 10 most active variants were selected for plasmid isolation and DNA sequencing.

Example 8: Point Mutation at Residue Position Corresponding to BpF294

Figure 12:
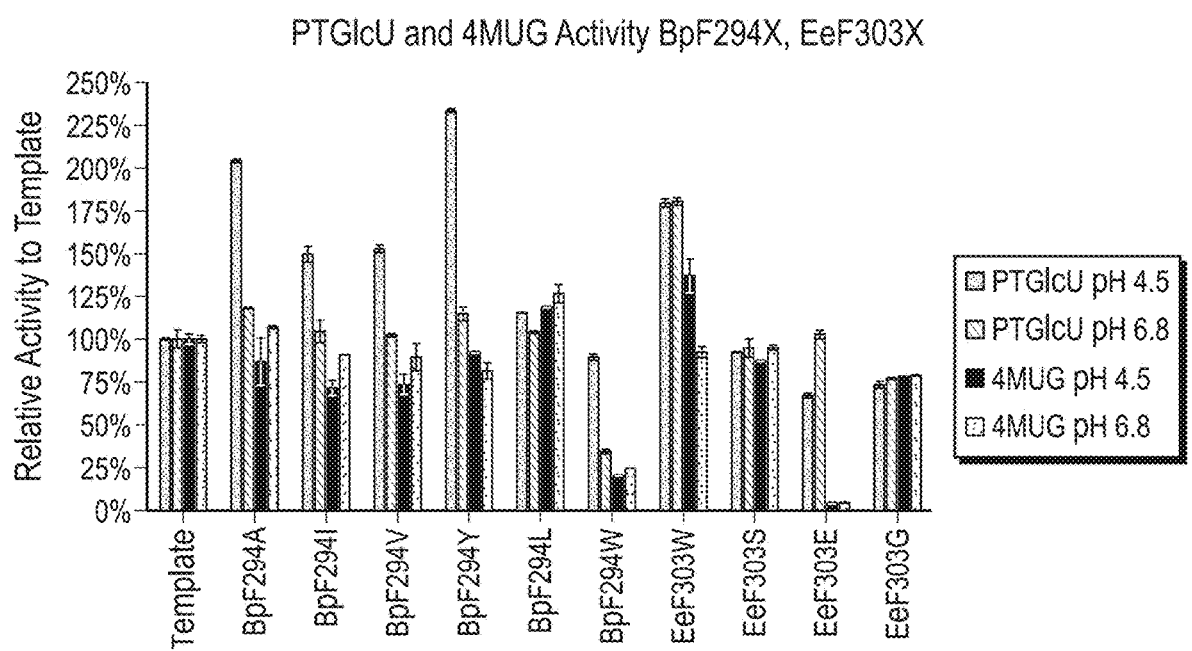
FIG. 12 is a bar graph showing the enzymatic activity of the BpF294X and EeF303X variant enzymes on the PTGlcU and 4MUG substrates.
Figure 13:
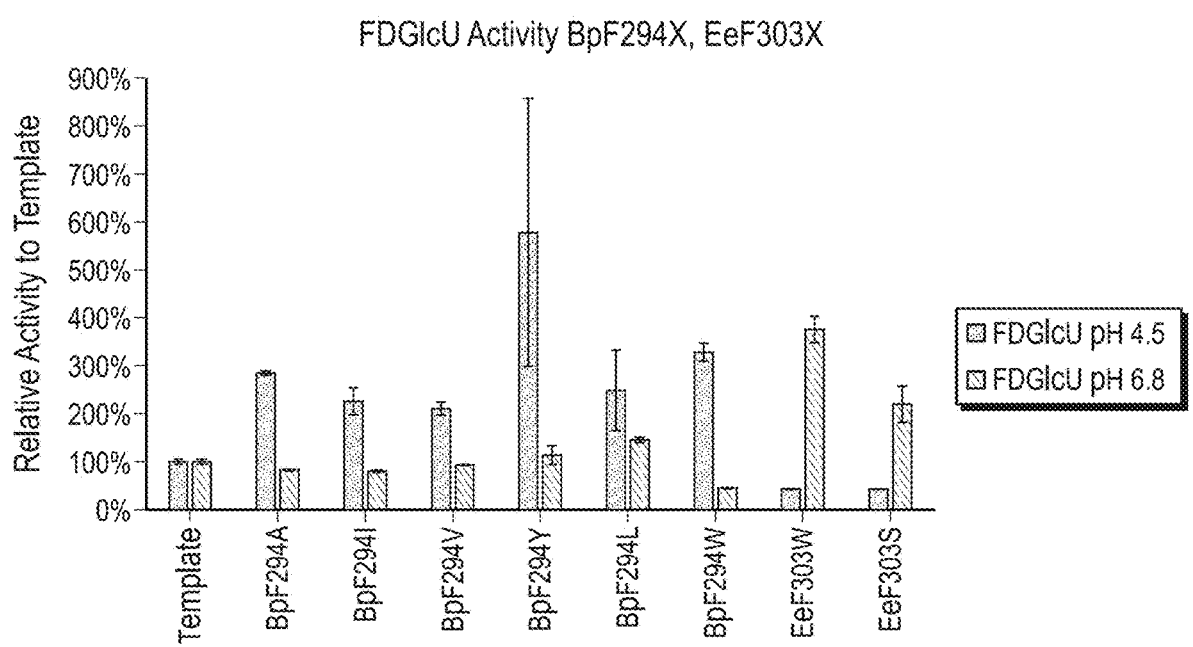
FIG. 13 is a bar graph showing the enzymatic activity of the BpF294X and EeF303X variant enzymes on the FDGlcU substrate.
Figure 14:
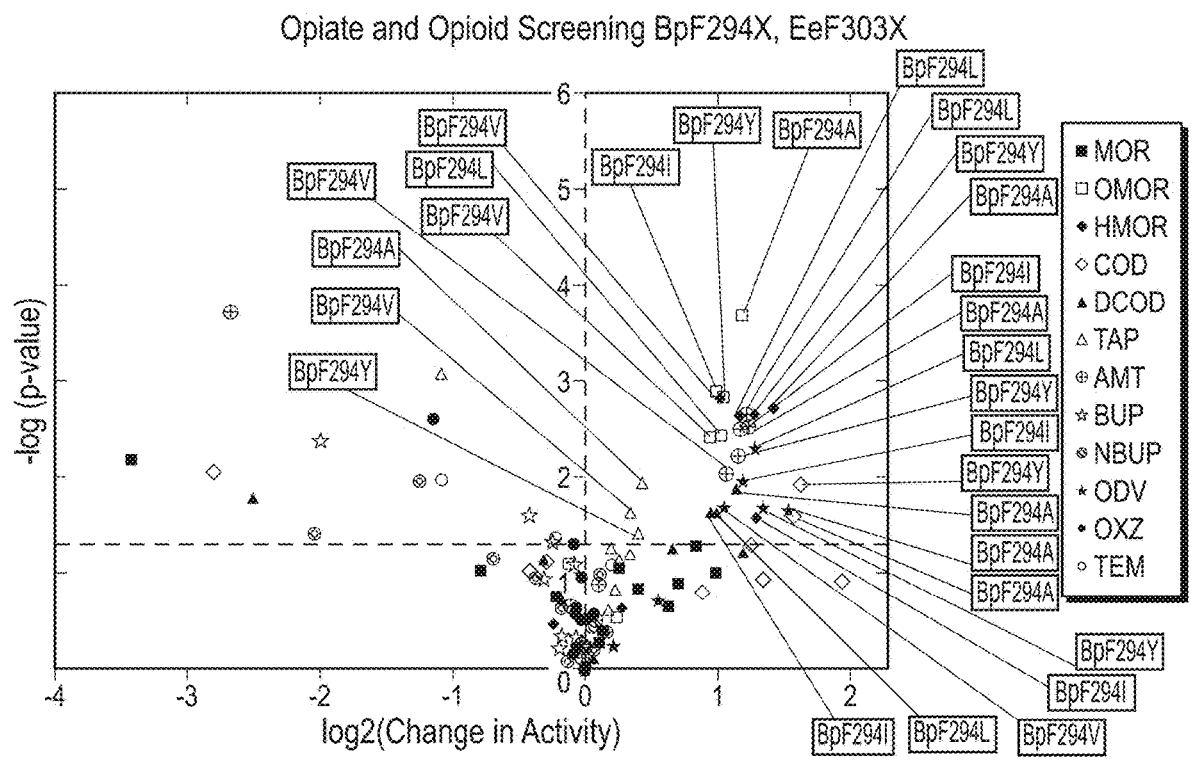
FIG. 14 is a graph showing the significant enzymatic activity of the BpF294X and EeF303X variant enzymes on a panel of opiate and opioid substrates.

In this example, the first amino acid residue within Variant Site 1 shown in FIG. 1 was mutated and the enzymatic activity of the variants tested on a panel of substrates. This residue corresponds to positions BpF294 and EeF303. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 12. The results for the FDGlcU substrate, as compared to template, are shown in FIG. 13. The results for a panel of opiates and opioids are shown in FIG. 14. In FIG. 14, variants indicated in the upper right quadrant of the graph exhibited increased activity as compared to template.

In summary, the results from FIGS. 12-14 demonstrate that the following BpGUS single point variants exhibited enhanced enzymatic activity against at least one, and often multiple, substrates as compared to the template from which the variant was derived: BpF294A, BpF294I, BpF294V, BpF294Y, BpF294L and BpF294W, the amino acid sequences of which are shown in SEQ ID NOs: 47-52, respectively.

In summary, the results from FIGS. 12-14 demonstrate that the following EeGUS single point variants exhibited enhanced enzymatic activity against at least one, and often multiple, substrates as compared to the template from which the variant was derived: EeF303W and EeF303S, the amino acid sequences of which are shown in SEQ ID NOs: 53 and 54, respectively.

Example 9: Point Mutation at Residue Position Corresponding to BpT295

Figure 15:
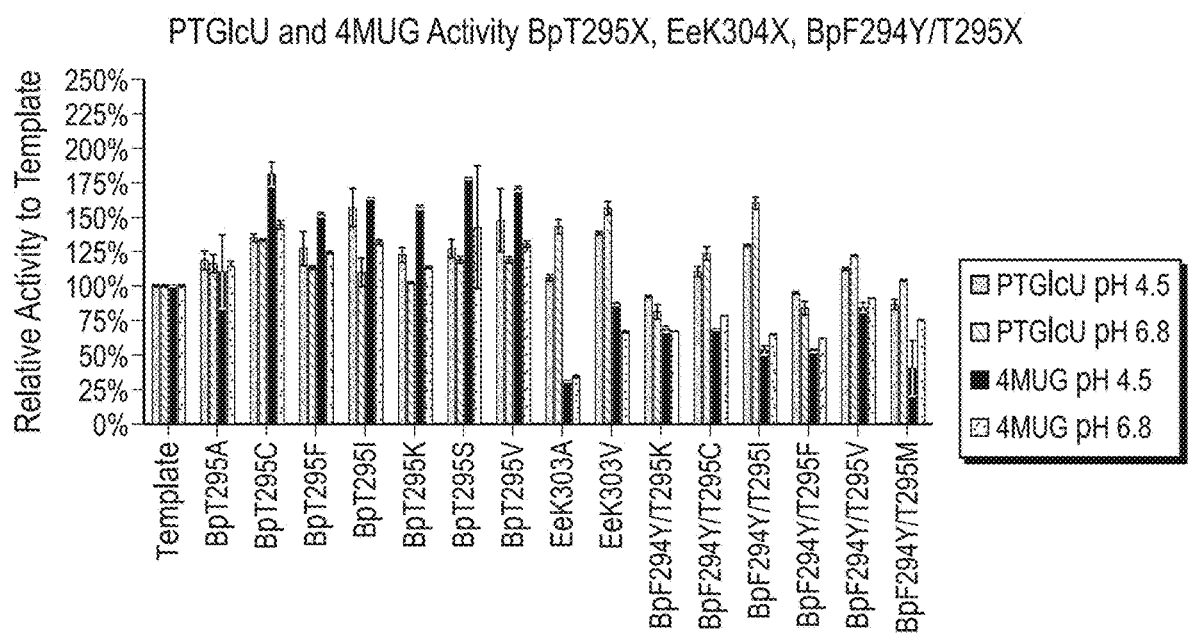
FIG. 15 is a bar graph showing the enzymatic activity of the BpT295X, EeK304X and BpF294Y/T295X variant enzymes on the PTGlcU and 4MUG substrates.
Figure 16:
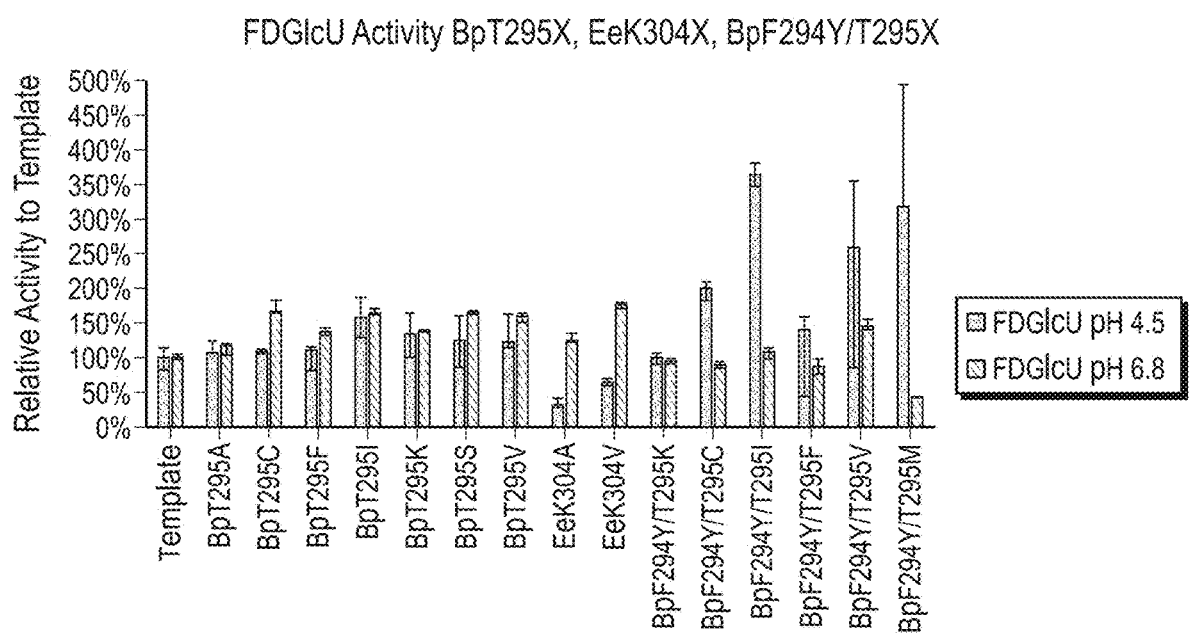
FIG. 16 is a bar graph showing the enzymatic activity of the BpT295X, EeK304X and BpF294Y/T295X variant enzymes on the FDGlcU substrate.
Figure 17:
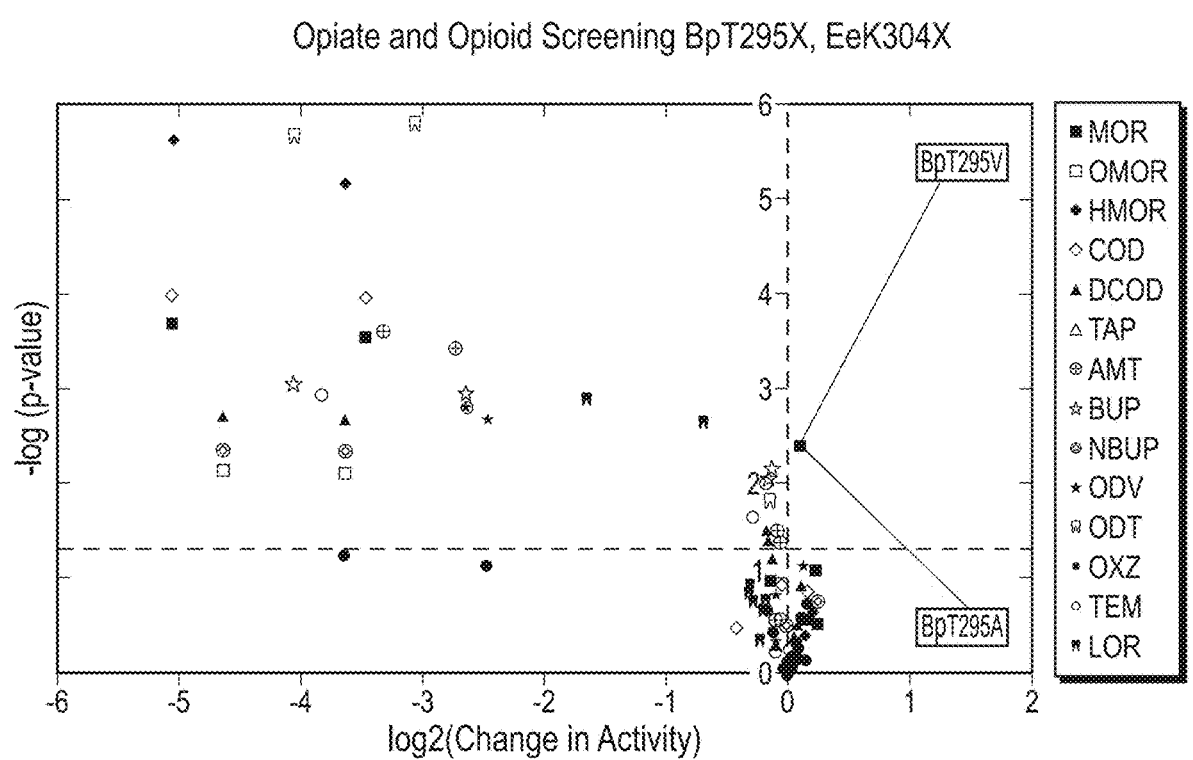
FIG. 17 is a graph showing the significant enzymatic activity of the BpT295X and EeK304X variant enzymes on a panel of opiate and opioid substrates.

In this example, the second amino acid residue within Variant Site 1 shown in FIG. 1 was mutated and the enzymatic activity of the variants tested on a panel of substrates. This residue corresponds to positions BpT295 and EeK304. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the FTGlcU and 4MUG substrates are shown in FIG. 15. The results for the FDGlcU substrate, as compared to template, are shown in FIG. 16. The results for a panel of opiates and opioids are shown in FIG. 17. In FIG. 17, variants indicated in the upper right quadrant of the graph exhibited increased activity as compared to template.

In summary, the results from FIGS. 15-17 demonstrate that the following BpGUS single point variants exhibited enhanced enzymatic activity against at least one, and often multiple, substrates as compared to the template from which the variant was derived: BpT295A, BpT295C, BpT295F, BpT295I, BpT295K, BpT295S and BpT295V, the amino acid sequences of which are shown in SEQ ID NOs: 55-61, respectively.

In summary, the results from FIGS. 15-17 demonstrate that the following EeGUS single point variants exhibited enhanced enzymatic activity against at least one, and often multiple, substrates as compared to the template from which the variant was derived: EeK304A and EeK304V, the amino acid sequences of which are shown in SEQ ID NOs: 62 and 63, respectively.

Example 10: Point Mutation at Residue Position Corresponding to BpI450

Figure 18:
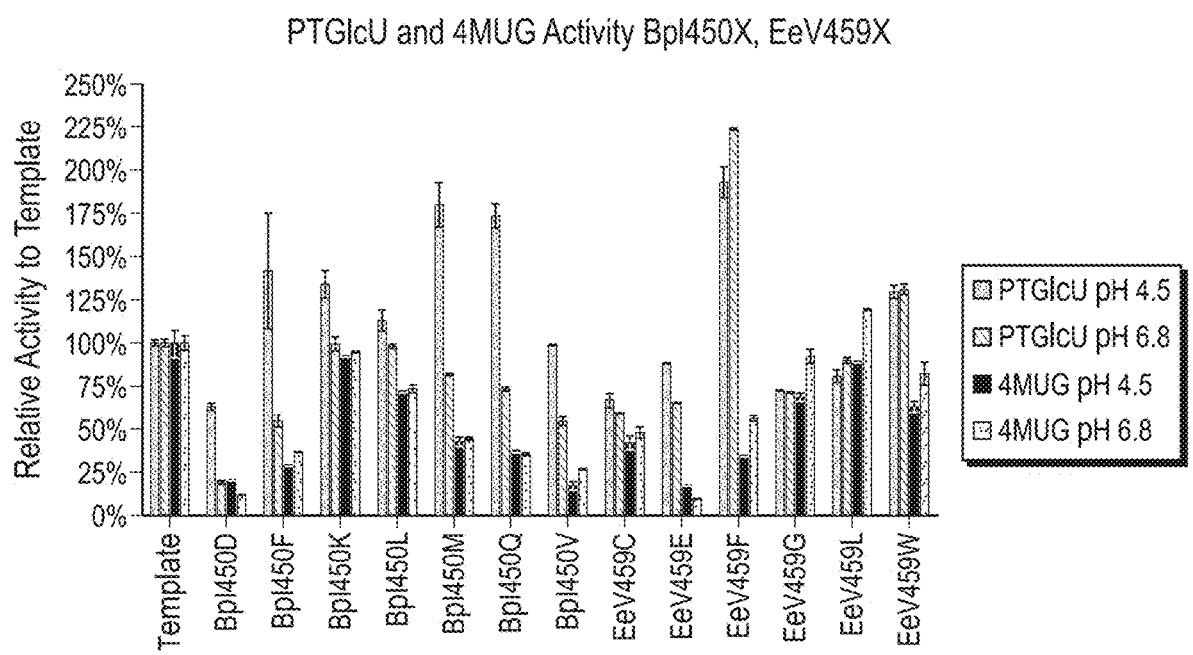
FIG. 18 is a bar graph showing the enzymatic activity of the BpI450X and EeV459X variant enzymes on the PTGlcU and 4MUG substrates.
Figure 19:
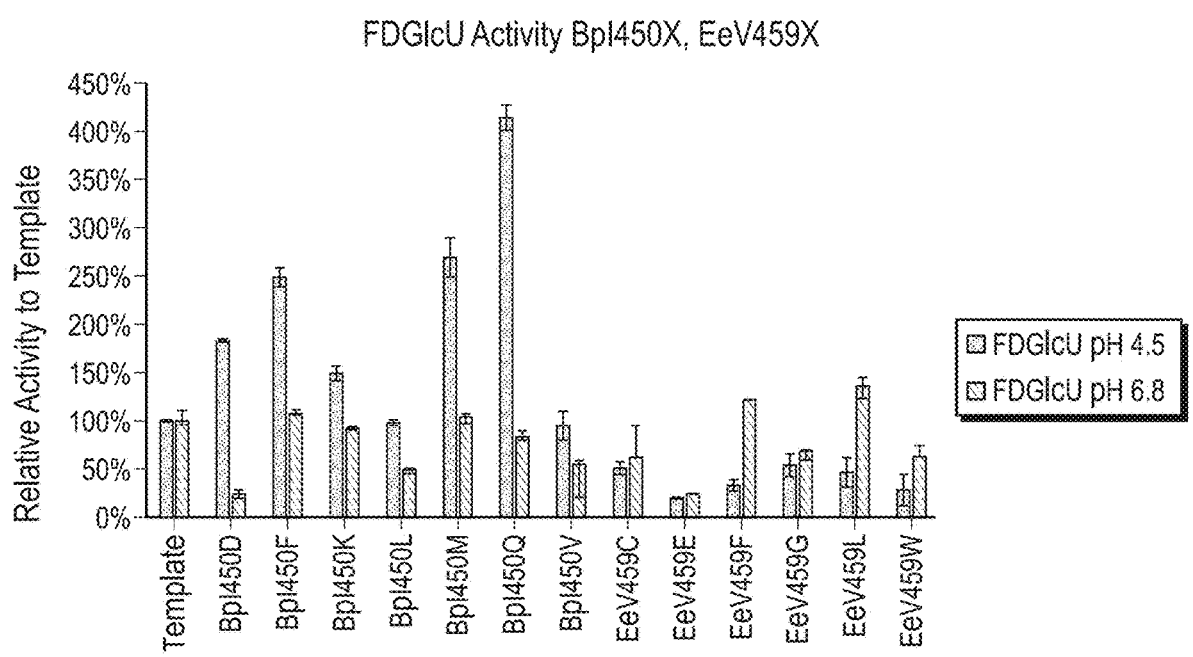
FIG. 19 is a bar graph showing the enzymatic activity of the BpI450X and EeV459X variant enzymes on the FDGlcU substrate.
Figure 20:
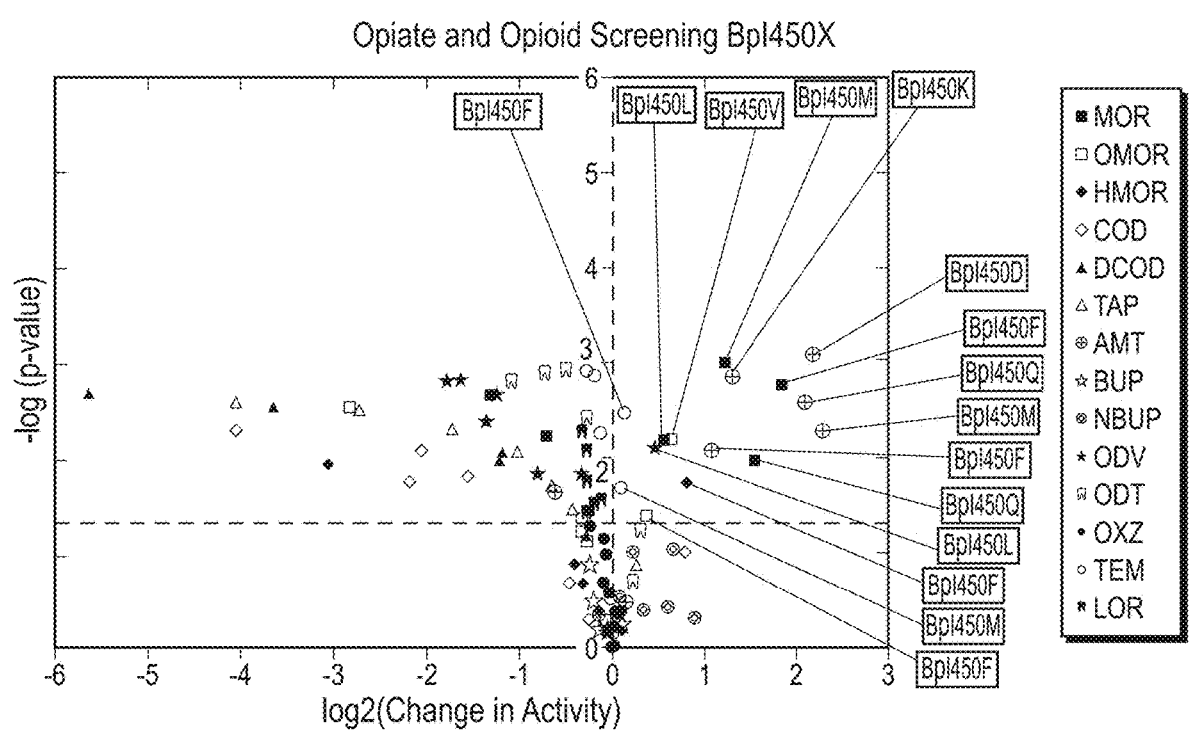
FIG. 20 is a graph showing the significant enzymatic activity of the BpI450X variant enzymes on a panel of opiate and opioid substrates.
Figure 21:
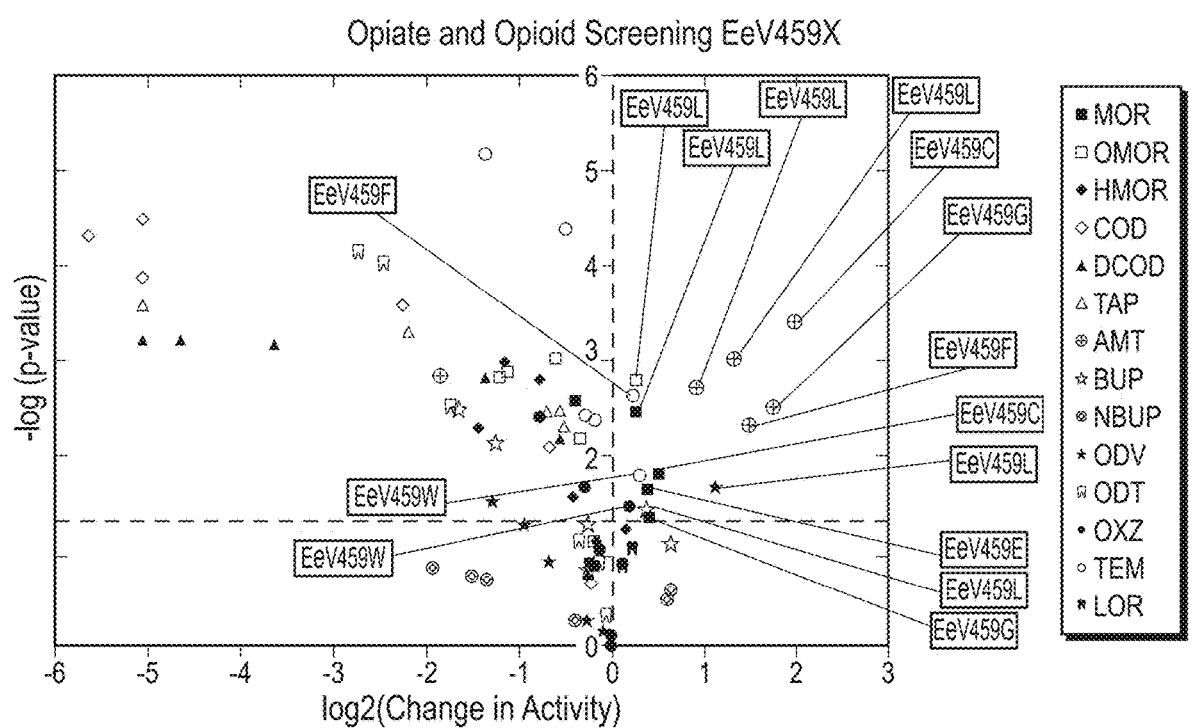
FIG. 21 is a graph showing the significant enzymatic activity of the EeV459X variant enzymes on a panel of opiate and opioid substrates.

In this example, the first amino acid residue within Variant Site 2 shown in FIG. 1 was mutated and the enzymatic activity of the variants tested on a panel of substrates. This residue corresponds to positions BpI450, EeV459, and Rxn3Y447. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 18 for BpI450 and EeV459, and FIGS. 35 and 36 for Rxn3Y447. The results for the FDGlcU substrate, as compared to template, are shown in FIG. 19 for BpI450 and EeV459. The results for the BpI450 variants on a panel of opiates and opioids are shown in FIG. 20. The results for the EeV459 variants on a panel of opiates and opioids are shown in FIG. 21. The results for the Rxn3Y447 variants on a panel of opiates and opioids are shown in FIG. 37. In FIGS. 20, 21 and 37, variants indicated in the upper right quadrant of the graph exhibited increased activity as compared to template.

In summary, the results from FIGS. 18-20 demonstrate that the following BpGUS single point variants exhibited enhanced enzymatic activity against at least one, and often multiple, substrates as compared to the template from which the variant was derived: BpI450F, BpI450K, BpI450L, BpI450M, BpI450Q, BpI450D and BPI450V, the amino acid sequences of which are shown in SEQ ID NOs: 64-70, respectively.

In summary, the results from FIGS. 18, 19 and 21 demonstrate that the following EeGUS single point variants exhibited enhanced enzymatic activity against at least one, and often multiple, substrates as compared to the template from which the variant was derived: EeV459F, EeV459L, EeV459W, EeV459C, EeV459G and EeV459E, the amino acid sequences of which are shown in SEQ ID NOs: 71-76, respectively.

Figure 35:
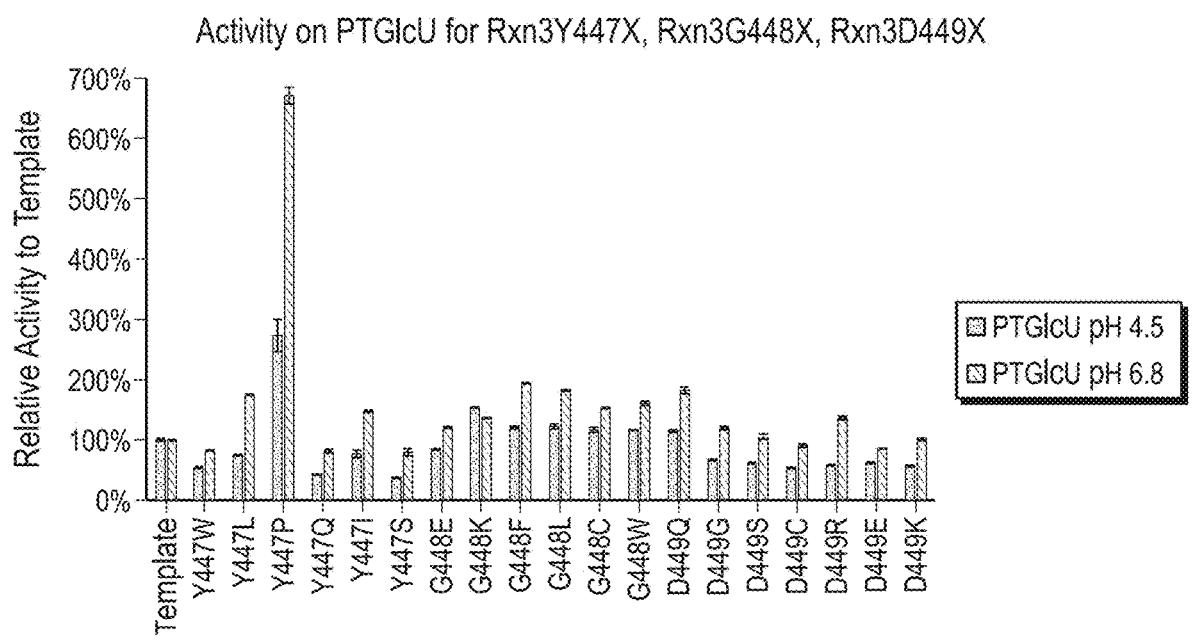
FIG. 35 is a bar graph showing the enzymatic activity of Rxn3Y447X, Rxn3G448X and Rxn3D449X variant enzymes on the PTGlcU substrate.
Figure 36:
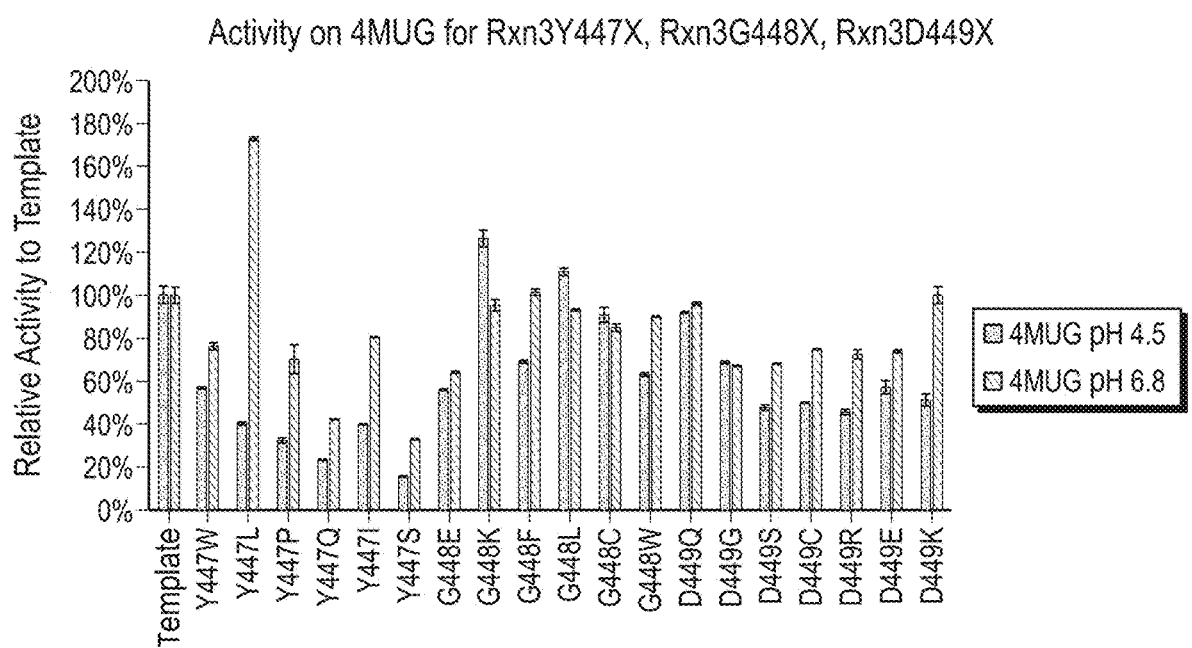
FIG. 36 is a bar graph showing the enzymatic activity of Rxn3Y447X, Rxn3G448X and Rxn3D449X variant enzymes on the 4MUG substrate.
Figure 37:
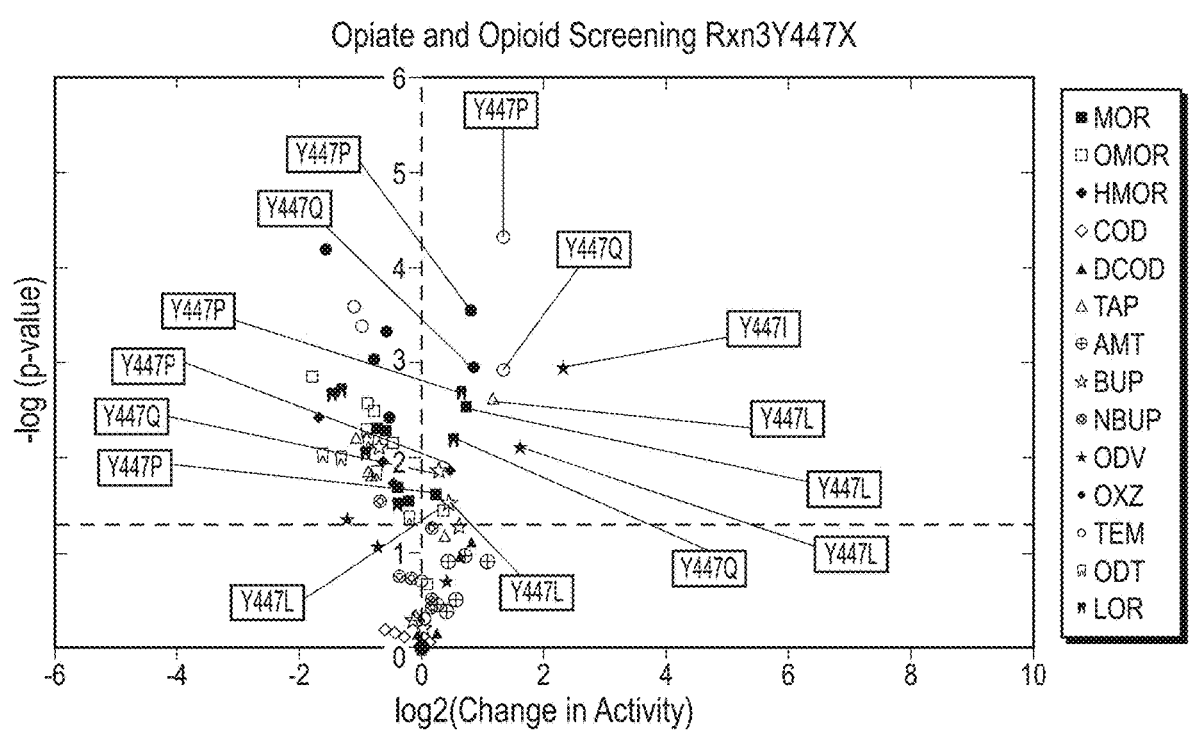
FIG. 37 is a graph showing the enzymatic activity of the Rxn3Y447X variant enzymes on a panel of opiate and opioid substrates.

In summary, the results from FIGS. 35, 36 and 37 demonstrate that the following Rxn3 single point variants exhibited enhanced enzymatic activity against at least one, and often multiple, substrates as compared to the template from which the variant was derived: Rxn3Y447L, Rxn3Y447P, Rxn3Y447I and Rxn3Y447Q, the amino acid sequences of which are shown in SEQ ID NOs: 121-124, respectively.

Example 11: Point Mutation at Residue Position Corresponding to BpQ451

Figure 22:
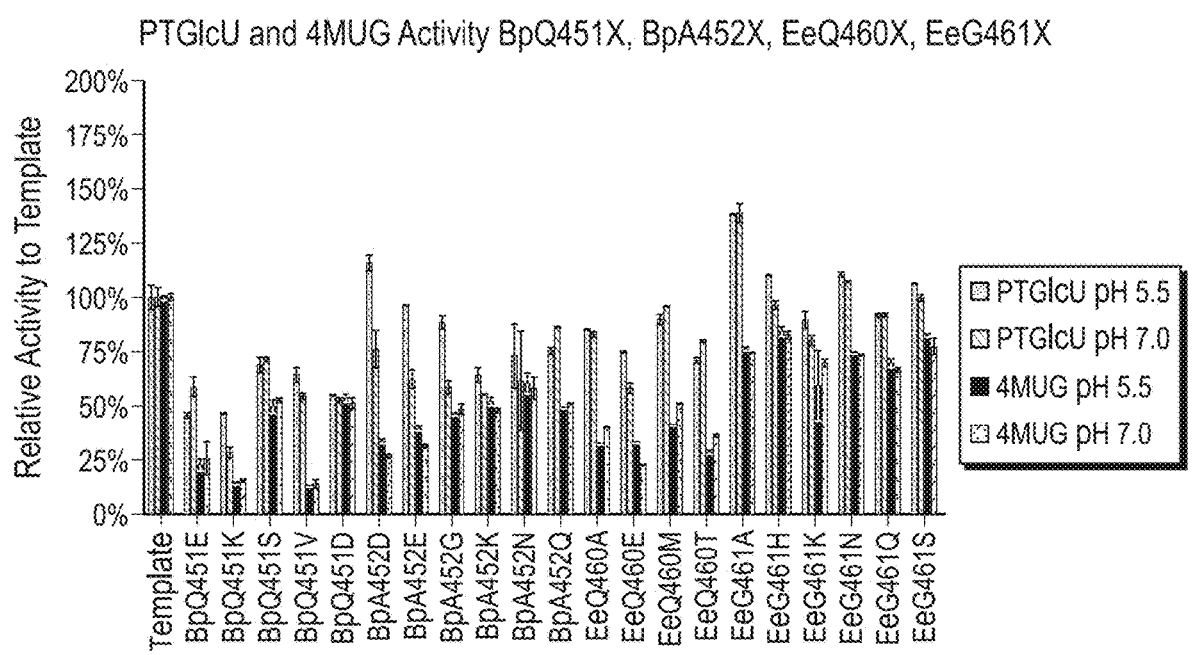
FIG. 22 is a bar graph showing the enzymatic activity of the BpQ451X, BpA452X, EeQ460X and EeG461X significant enzymes on the PTGlcU and 4MUG substrates.
Figure 23:
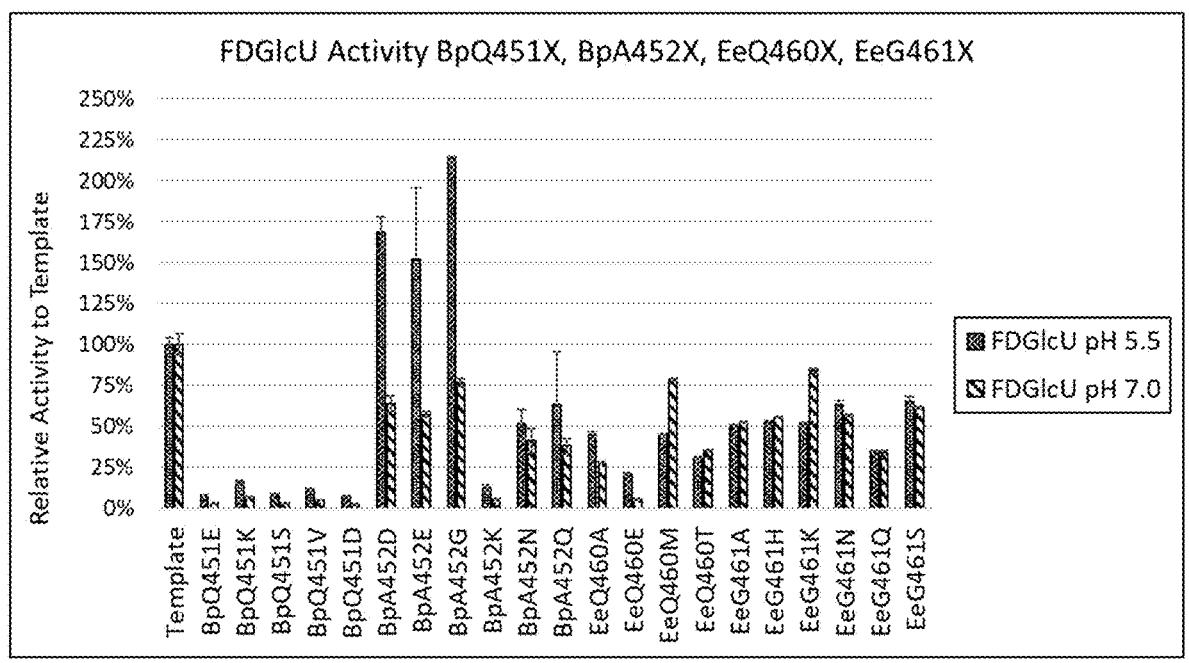
FIG. 23 is a bar graph showing the enzymatic activity of the BpQ451X, BpA452X, EeQ460X and EeG461X variant enzymes on the FDGlcU substrate.
Figure 24:
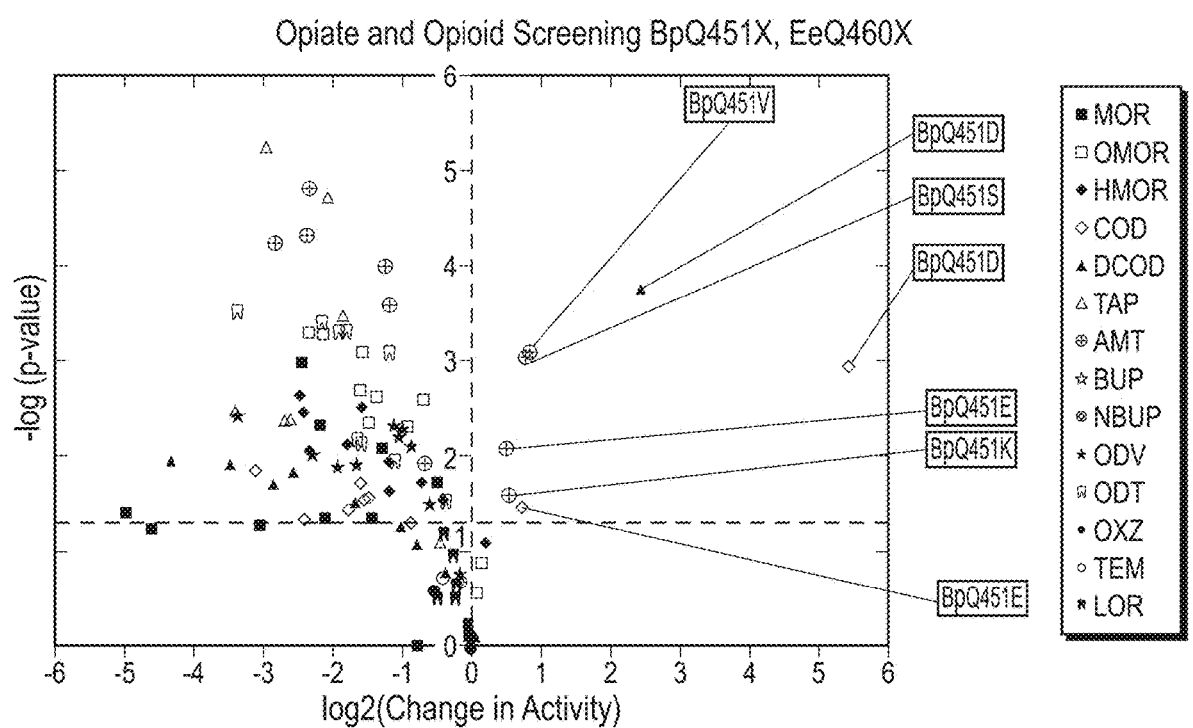
FIG. 24 is a graph showing the significant enzymatic activity of the BpQ451X and EeQ460X variant enzymes on a panel of opiate and opioid substrates.
Figure 38:
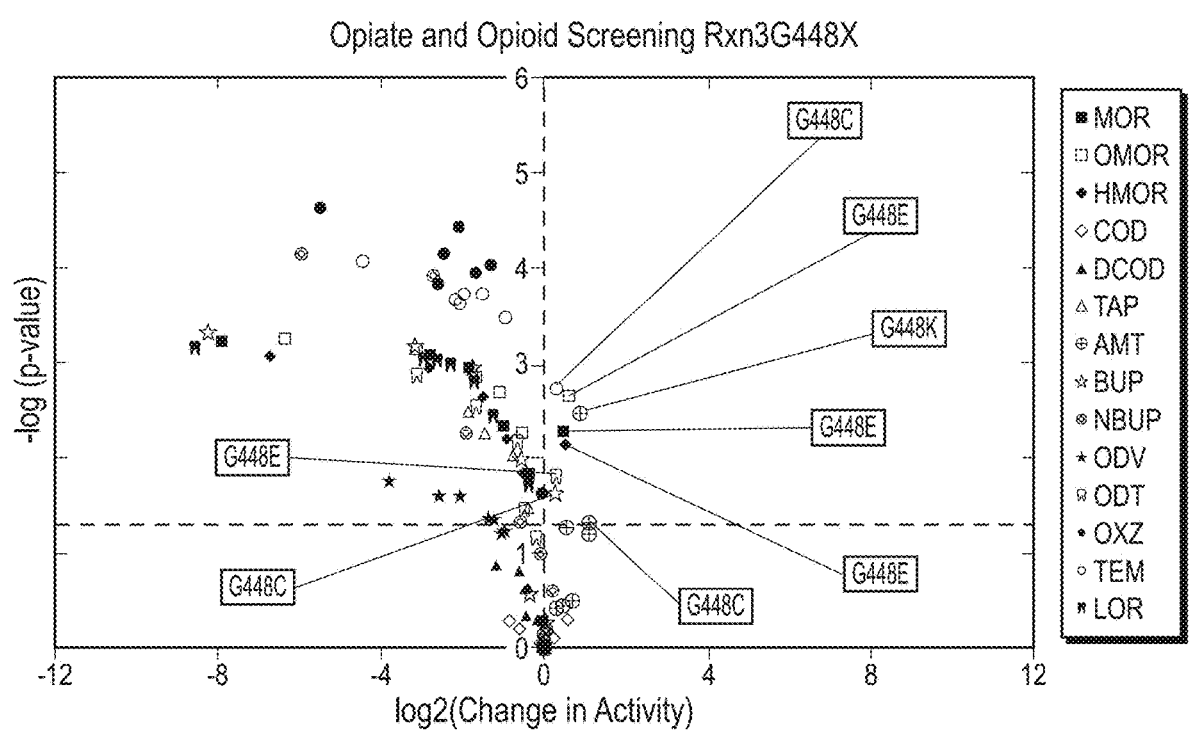
FIG. 38 is a graph showing the enzymatic activity of the Rxn3G448X variant enzymes on a panel of opiate and opioid substrates.

In this example, the second amino acid residue within Variant Site 2 shown in FIG. 1 was mutated and the enzymatic activity of the variants tested on a panel of substrates. This residue corresponds to positions BpQ451, EeQ460 and Rxn3G448. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 22 for BpQ451 and EeQ460, and FIGS. 35 and 36 for Rxn3G448. The results for the FDGlcU substrate, as compared to template, are shown in FIG. 23 for BpQ451 and EeQ460. The results for BpQ451 and EeQ460 variants on a panel of opiates and opioids are shown in FIG. 24. The results for the Rxn3G448 variants on a panel of opiates and opioids are shown in FIG. 38. In FIGS. 24 and 38, variants indicated in the upper right quadrant of the graph exhibited increased activity as compared to template.

In summary, the results from FIGS. 22-24 demonstrate that the following BpGUS single point variants exhibited enhanced enzymatic activity against at least one, and often multiple, substrates as compared to the template from which the variant was derived: BpQ451D, BpQ451E, BpQ451G, BpQ451S, BpQ451V and BpQ451K, the amino acid sequences of which are shown in SEQ ID NOs: 77-82, respectively. Moreover, the data shown in FIG. 24 demonstrates that the BpQ451 D showed exceptionally high enzymatic activity against the codeine-6-β-D-glucuronide (COD) substrate as compared to the parental BpGUS enzyme.

In summary, the results from FIGS. 35, 36 and 38 demonstrate that the following Rxn3 single point variants exhibited enhanced enzymatic activity against at least one, and often multiple, substrates as compared to the template from which the variant was derived: Rxn3G448E, Rxn3G448K, Rxn3G448F, Rxn3G448L, Rxn3G448C and Rxn3G448W, the amino acid sequences of which are shown in SEQ ID NOs: 125-130, respectively.

Example 12: Point Mutation at Residue Position Corresponding to BpA452

Figure 25:
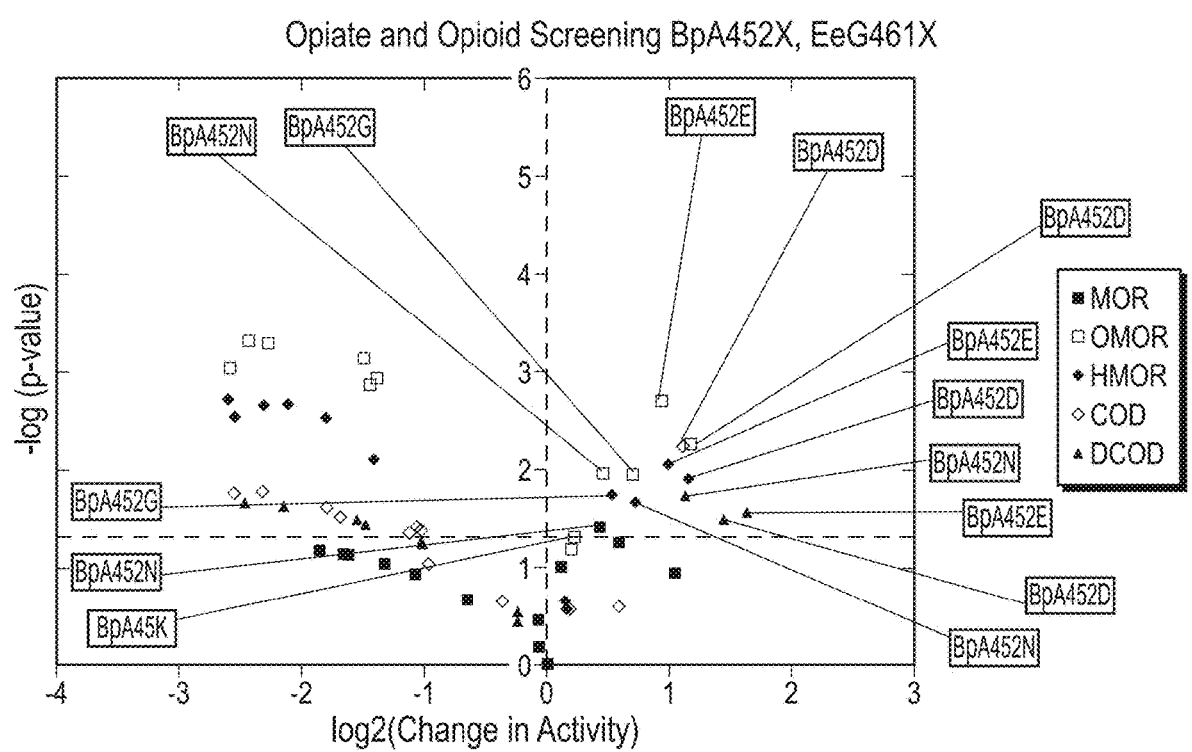
FIG. 25 is a graph showing the significant enzymatic activity of the BpA452X and EeG461X variant enzymes on a panel of opiate and opioid substrates.
Figure 26:
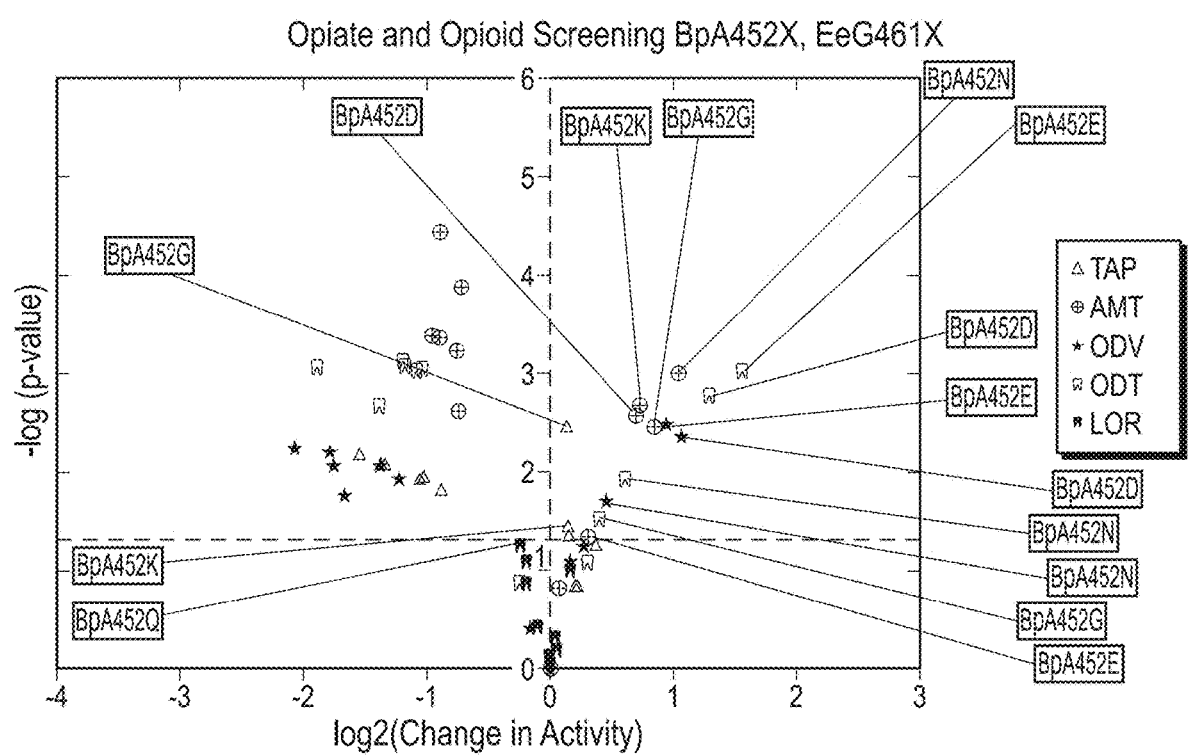
FIG. 26 is a graph showing the enzymatic activity of the BpA452X and EeG461X variant enzymes on a panel of opiate and opioid substrates.
Figure 39:
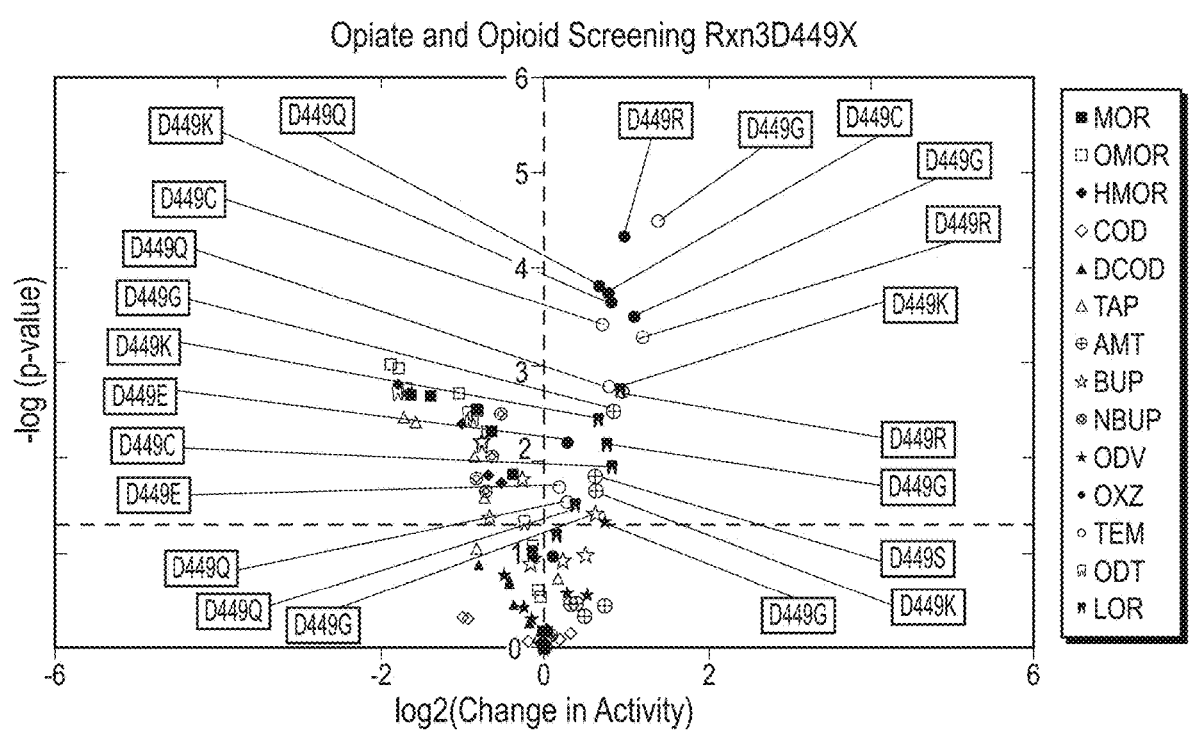
FIG. 39 is a graph showing the enzymatic activity of the Rxn3D449X variant enzymes on a panel of opiate and opioid substrates.

In this example, the third amino acid residue within Variant Site 2 shown in FIG. 1 was mutated and the enzymatic activity of the variants tested on a panel of substrates. This residue corresponds to positions BpA452, EeG461 and Rxn3D449. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 22 for BpA452 and EeG461, and FIGS. 35 and 36 for Rxn3D449. The results for the FDGlcU substrate, as compared to template, are shown in FIG. 23 for BpA452 and EeG461. The results for these variants on two different panels of opiates and opioids are shown in FIGS. 25 and 26 for BpA452 and EeG461. The results for the Rxn3D449 variants on a panel of opiates and opioids are shown in FIG. 39. In FIGS. 25, 26 and 39, variants indicated in the upper right quadrant of the graph exhibited increased activity as compared to template.

In summary, the results from FIGS. 22, 23, 25 and 26 demonstrate that the following BpGUS single point variants exhibited enhanced enzymatic activity against at least one, and often multiple, substrates as compared to the template from which the variant was derived: BpA452D, BpA452K, BpA452N, BpA452G, BpA452E and BPA452Q, the amino acid sequences of which are shown in SEQ ID NOs: 83-88, respectively.

In summary, the results from FIGS. 22, 23, 25 and 26 demonstrate that the following EeGUS single point variants exhibited enhanced enzymatic activity against at least one, and often multiple, substrates as compared to the template from which the variant was derived: EeG461A, EeG461H, EeG461N and EeG461S, the amino acid sequences of which are shown in SEQ ID NOs: 89-92, respectively.

In summary, the results from FIGS. 35, 36 and 39 demonstrate that the following Rxn3 single point variants exhibited enhanced enzymatic activity against at least one, and often multiple, substrates as compared to the template from which the variant was derived: Rxn3D449Q, Rxn3D449G, Rxn3D449R, Rxn3D449K, Rxn3D449S, Rxn3D449C, and Rxn3D449E, the amino acid sequences of which are shown in SEQ ID NOs: 131-137, respectively.

Example 13: Point Mutation at Residue Position Corresponding to BpG563

Figure 27:
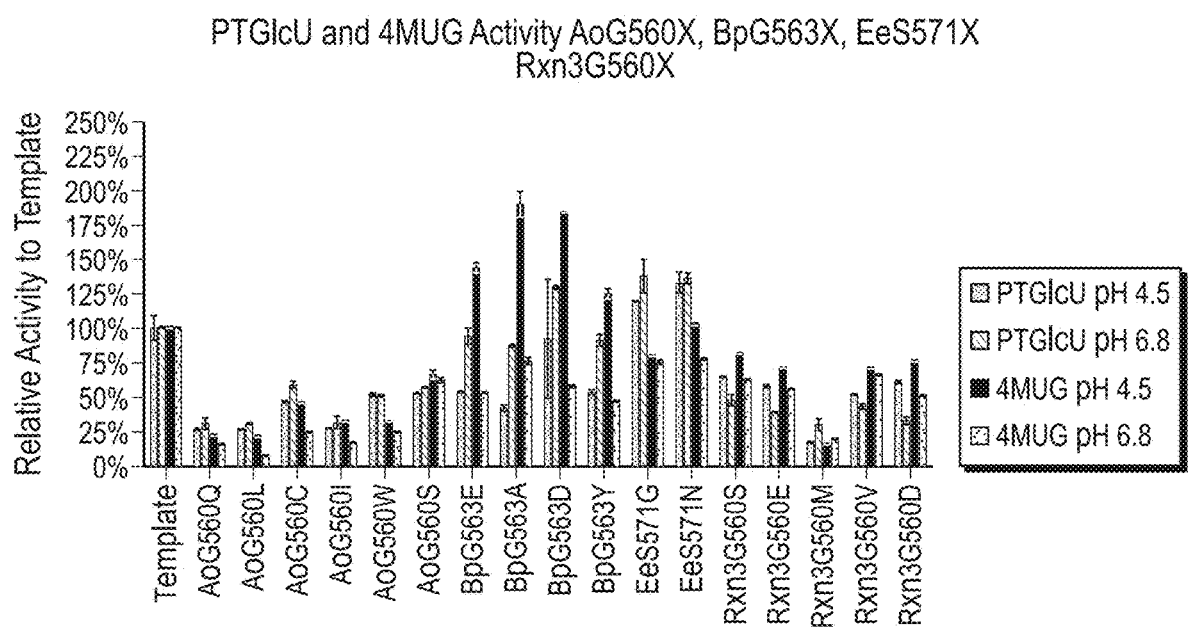
FIG. 27 is a bar graph showing the enzymatic activity of the AoG560X, BpG563X, EeS571X and Rxn3G560X variant enzymes on the PTGlcU and 4MUG substrates.
Figure 28:
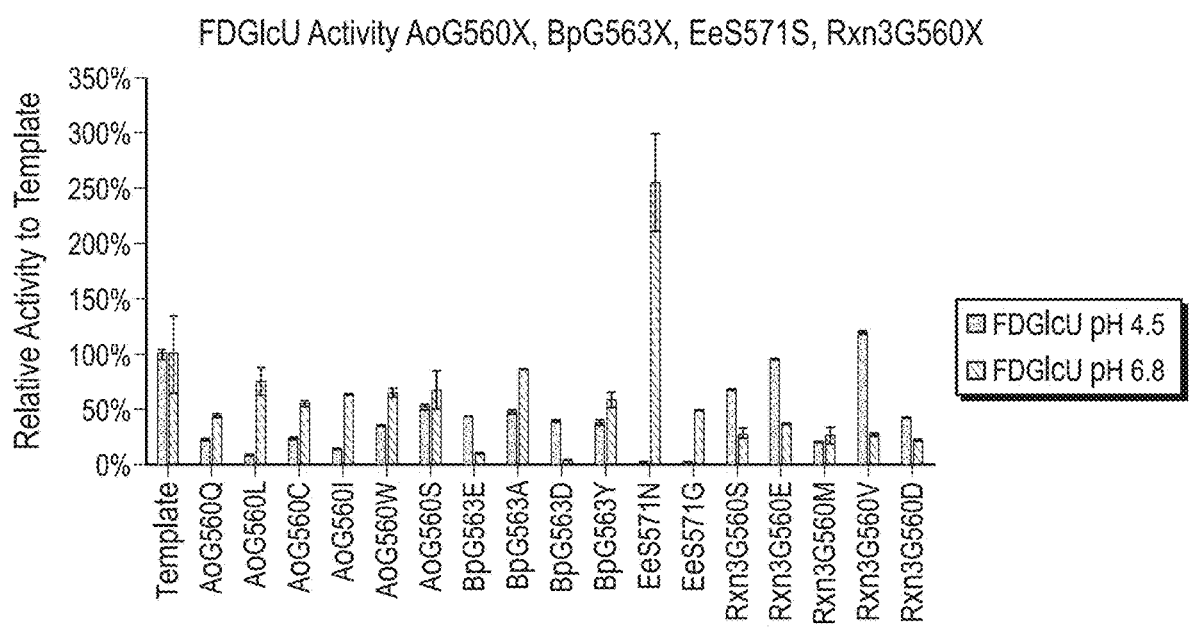
FIG. 28 is a bar graph showing the enzymatic activity of the AoG560X, BpG563X, EeS571X and Rxn3G560X variant enzymes on the FDGlcU substrate.
Figure 29:
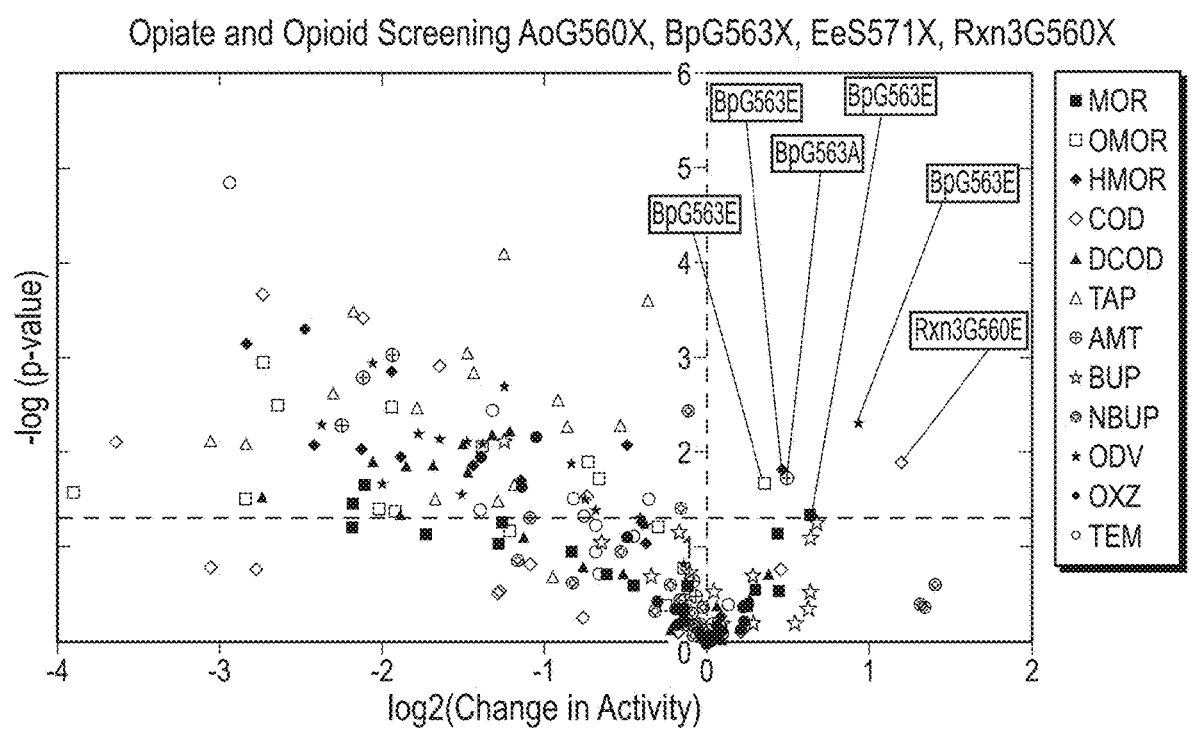
FIG. 29 is a graph showing the significant enzymatic activity of the AoG560X, BpG563X, EeS571X and Rxn3G560X variant enzymes on a panel of opiate and opioid substrates.

In this example, the amino acid residue at Variant Site 3 shown in FIG. 1 was mutated and the enzymatic activity of the variants tested on a panel of substrates. This residue corresponds to positions BpG563, EeS571, AoG560 and Rxn3G560. Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 27. The results for the FDGlcU substrate, as compared to template, are shown in FIG. 28. The results for these variants on a panel of opiates and opioids are shown in FIG. 29. In FIG. 29, variants indicated in the upper right quadrant of the graph exhibited increased activity as compared to template.

In summary, the results from FIGS. 27-29 demonstrate that the following BpGUS single point variants exhibited enhanced enzymatic activity against at least one, and often multiple, substrates as compared to the template from which the variant was derived: BpG563E, BpG563A, BpG563D and BpG563Y, the amino acid sequences of which are shown in SEQ ID NOs: 93-96, respectively.

In summary, the results from FIGS. 27-29 demonstrate that the following EeGUS single point variants exhibited enhanced enzymatic activity against at least one, and often multiple, substrates as compared to the template from which the variant was derived: EeS571G and EeS571N, the amino acid sequences of which are shown in SEQ ID NOs: 97 and 98, respectively.

In summary, the results from FIGS. 27-29 demonstrate that the following Rxn3 single point variants exhibited enhanced enzymatic activity against at least one, and often multiple, substrates as compared to the template from which the variant was derived: Rxn3G560V and Rxn3G560E, the amino acid sequences of which are shown in SEQ ID NOs: 99 and 100, respectively.

Example 14: Double Point Variants

Figure 30:
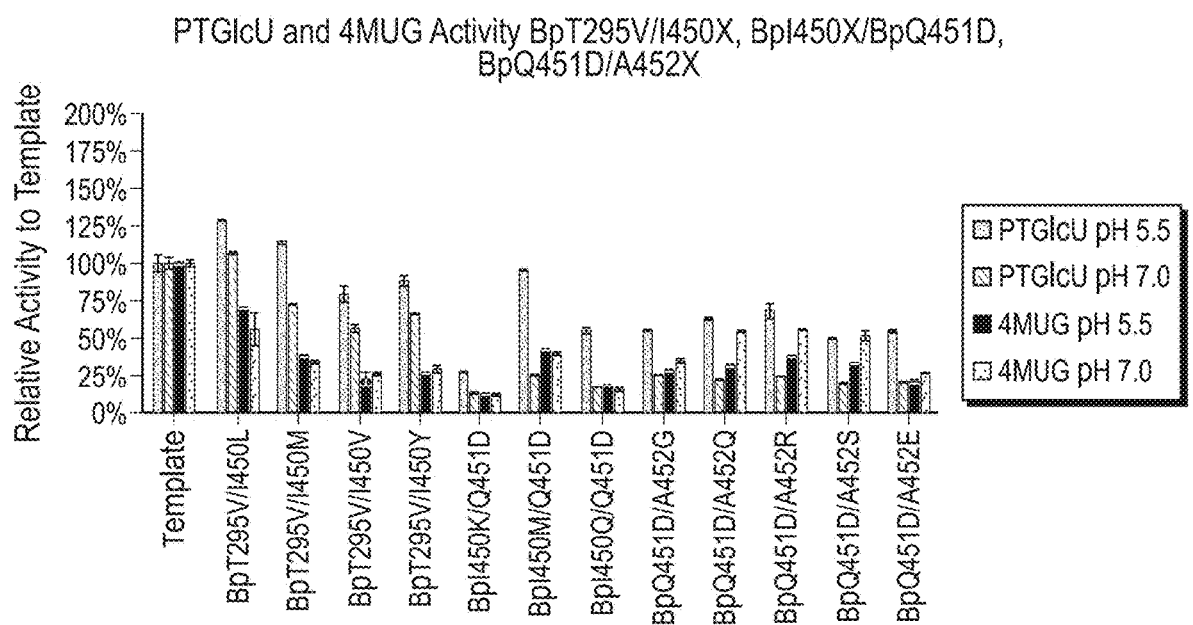
FIG. 30 is a bar graph showing the enzymatic activity of the BpT295V/I450X, BpI450X/Q451D and BpQ451D/A452X variant enzymes on the PTGlcU and 4MUG substrates.
Figure 31:
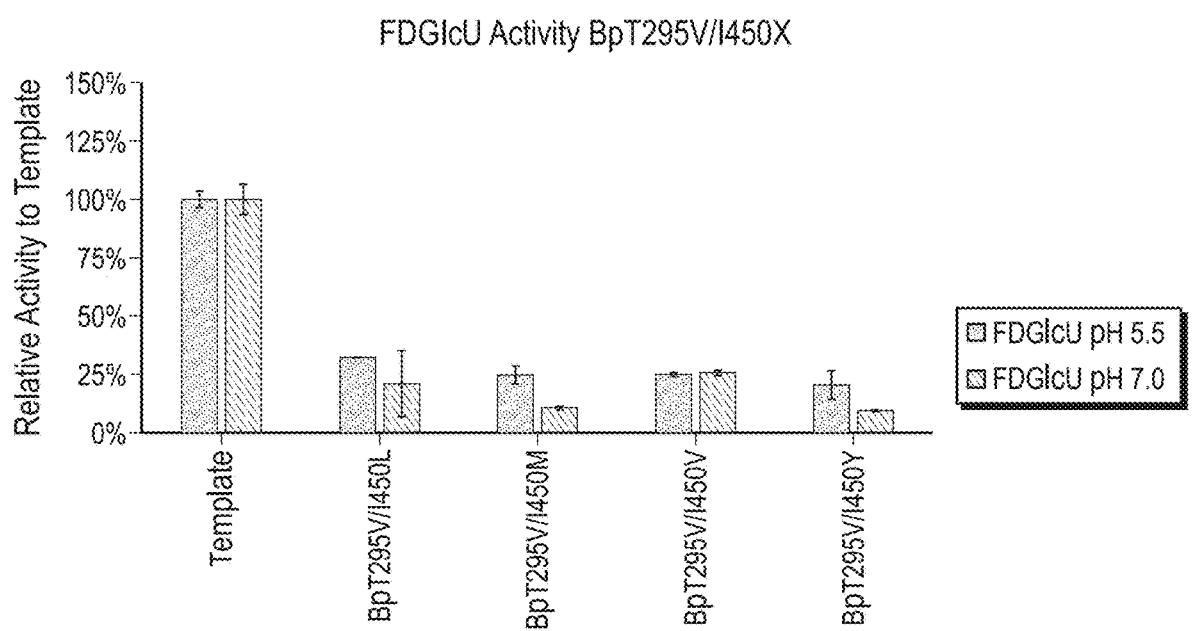
FIG. 31 is a bar graph showing the enzymatic activity of the BpT295V/I450X, BpI450X/Q451D and BpQ451D/A452X variant enzymes on the FDGlcU substrate.
Figure 32:
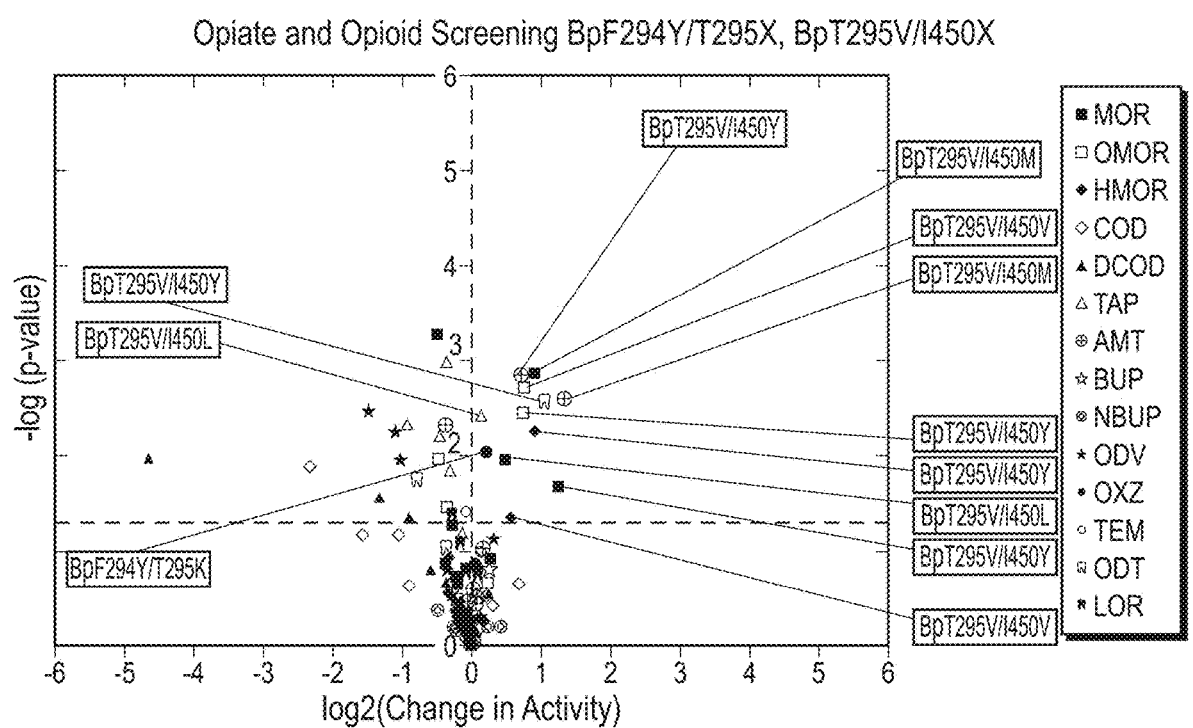
FIG. 32 is a graph showing the significant enzymatic activity of the BpF294Y/T295X and BpT295V/I450X variant enzymes on a panel of opiate and opioid substrates.
Figure 33:
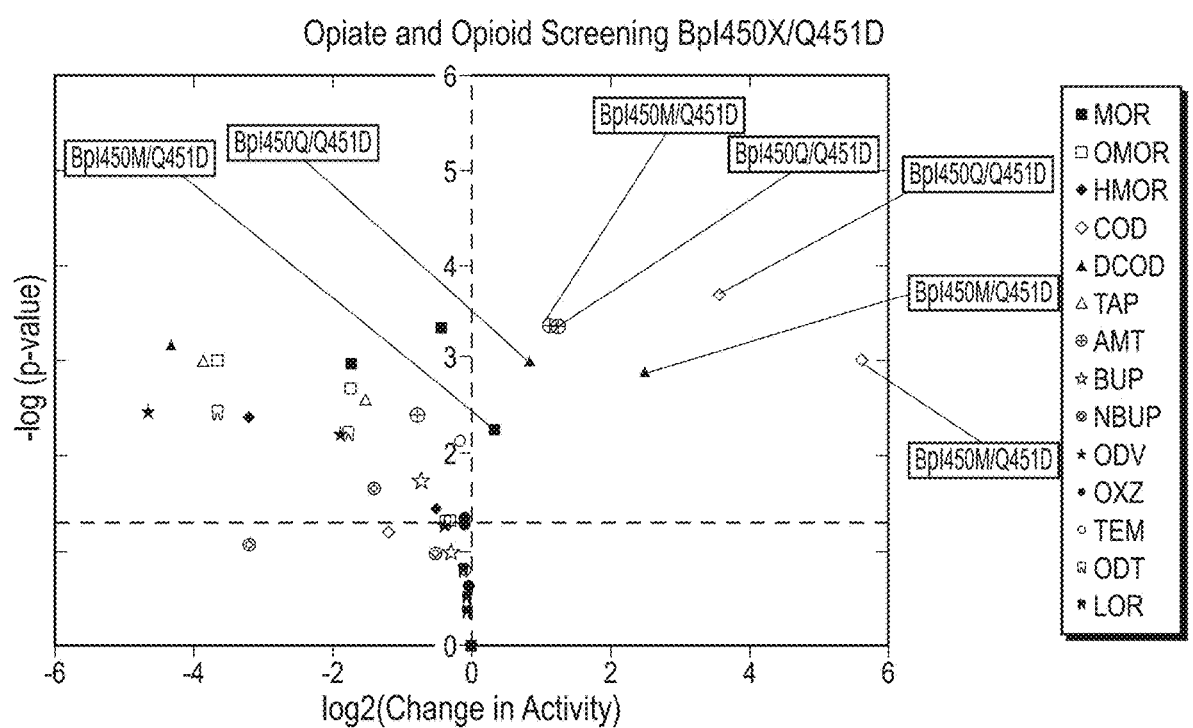
FIG. 33 is a graph showing the significant enzymatic activity of the BpI450X/Q451D variant enzymes on a panel of opiate and opioid substrates.
Figure 34:
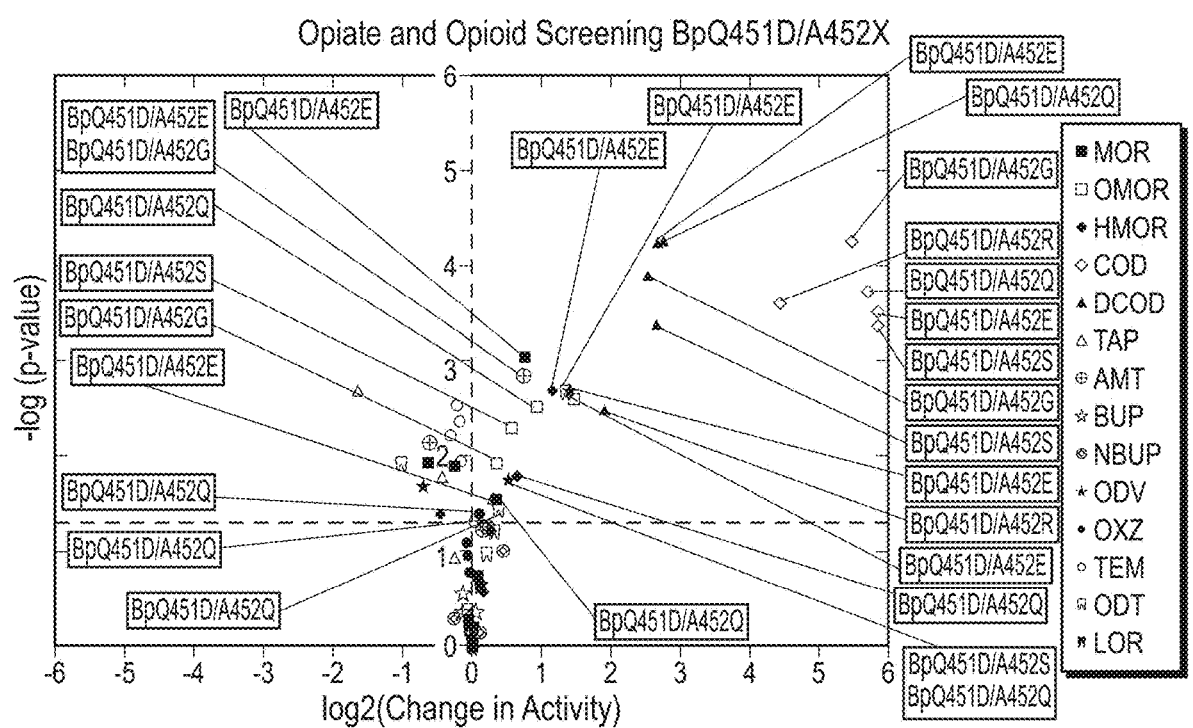
FIG. 34 is a graph showing the significant enzymatic activity of the BpQ451D/A452X variant enzymes on a panel of opiate and opioid substrates.

In this example, two point mutations were made at various combinations of amino acid residue with Variant Sites 1 and 2 shown in FIG. 1 and the enzymatic activity of the double point variants tested on a panel of substrates. These pairs of residues for the double variants tested correspond to positions BpF294/T295 (residues 1 and 2 of Variant Site 1), BpT295/I450 (residue 2 of Variant Site 1 and residue 1 of Variant Site 2), BpI450/Q451 (residues 1 and 2 of Variant Site 2) and BpQ451/A452 (residues 2 and 3 of Variant Site 2). Site-directed mutagenesis was performed as described in Example 7. The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIGS. 15 and 30. The results for the FDGlcU substrate, as compared to template, are shown in FIGS. 16 and 31. The results for the BpF294/T295 and BpT295/I450 variants on a panel of opiates and opioids are shown in FIG. 32. The results for the BpI450/Q451 variants on a panel of opiates and opioids are shown in FIG. 33. The results for the BpQ451/A452 variants on a panel of opiates and opioids are shown in FIG. 34. In FIGS. 32-34, variants indicated in the upper right quadrant of the graph exhibited increased activity as compared to template.

In summary, the results from FIGS. 15, 16 and 32 demonstrate that the following BpGUS F294/T295 double point variants exhibited enhanced enzymatic activity against at least one, and often multiple, substrates as compared to the template from which the variant was derived: BpF294Y/T295C, BpF294Y/T295I, BpF294Y/T295V, BpF294Y/T295F, BpF294Y/T295M, BpF294Y/T295K, the amino acid sequences of which are shown in SEQ ID NOs: 101-106.

In summary, the results from FIGS. 30-32 demonstrate that the following BpGUS T295/I450 double point variants exhibited enhanced enzymatic activity against at least one, and often multiple, substrates as compared to the template from which the variant was derived: BpT295V/I450L, BpT295V/I450M, BpT295V/I450Y and BpT295V/I450V, the amino acid sequences of which are shown in SEQ ID NOs: 107-110, respectively.

In summary, the results from FIGS. 30 and 33 demonstrate that the following BpGUS I450/Q451 double point variants exhibited enhanced enzymatic activity against at least one, and often multiple, substrates as compared to the template from which the variant was derived: BpI450M/Q451D and BpI450Q/Q451D, the amino acid sequences of which are shown in SEQ ID NOs: 111 and 112, respectively.

In summary, the results from FIGS. 30 and 34 demonstrate that the following BpGUS Q451/A452 double point variants exhibited enhanced enzymatic activity against at least one, and often multiple, substrates as compared to the template from which the variant was derived: BpQ451D/A452E, BpQ451D/A452G, BpQ451D/A452Q, BpQ451D/A452S and BpQ451D/A452R, the amino acid sequences of which are shown in SEQ ID NOs: 113-117, respectively. Moreover, the data shown in FIG. 34 demonstrates that the BpQ451D/A452E, BpQ451D/A452G, BpQ451D/A452Q, BpQ451 D/A452S and BpQ451D/A452R variants showed exceptionally high enzymatic activity against the codeine-6-β-D-glucuronide (COD) substrate as compared to the parental BpGUS enzyme.

Example 15: EeGUS Cysteine Variants

In this example, cysteine substitutions were made at various amino acid positions within the EeGUS enzyme. Positions substituted with cysteine included Q8, L53, S73, K326, P489, H526, Q570 and K588, as either single or double mutations. Site-directed mutagenesis was performed as described in Example 7.

Figure 40:
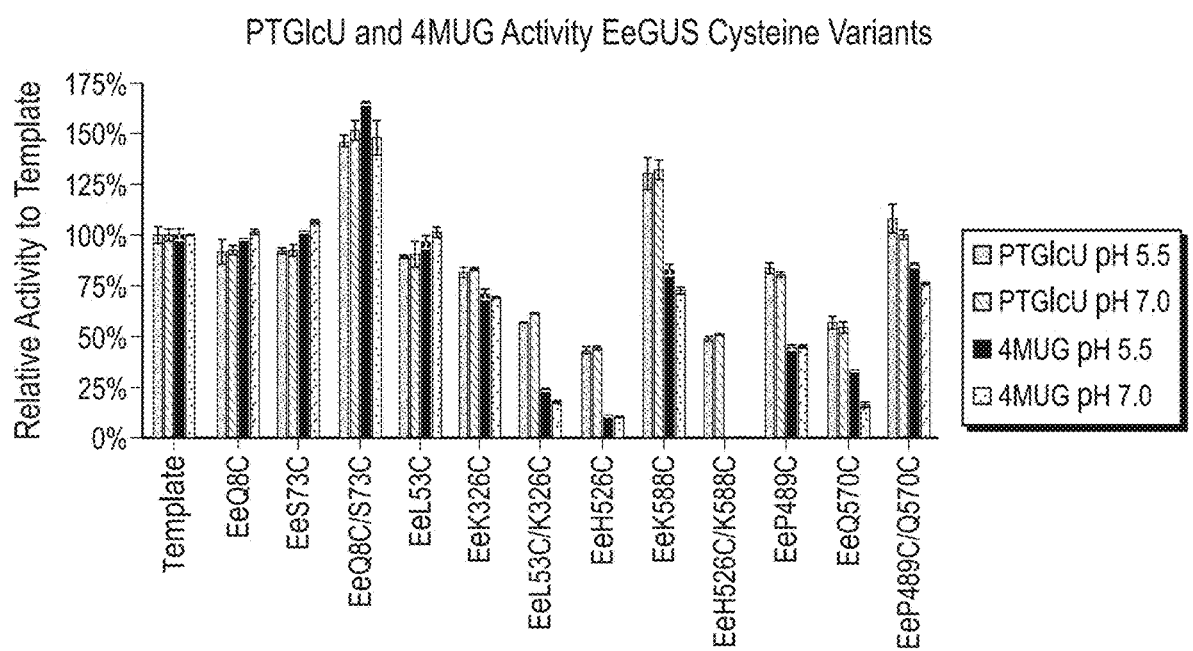
FIG. 40 is a bar graph showing the enzymatic activity of the indicated EeGUS cysteine variant enzymes on the PTGlcU and 4MUG substrates.

The enzymatic activity of the variants was compared to the parental enzyme (i.e., unmutated enzyme, also referred to herein as the template), often under two different pH conditions. The results using these variants, as compared to template, using the PTGlcU and 4MUG substrates are shown in FIG. 40. Furthermore, FIG. 41 displays the opiate and opioid activity of EeQ8C/S73C compared to template. EeQ8C/S73C had significant increases in activity on several different substrates where * indicates a p-value less than 0.05.

Figure 42:
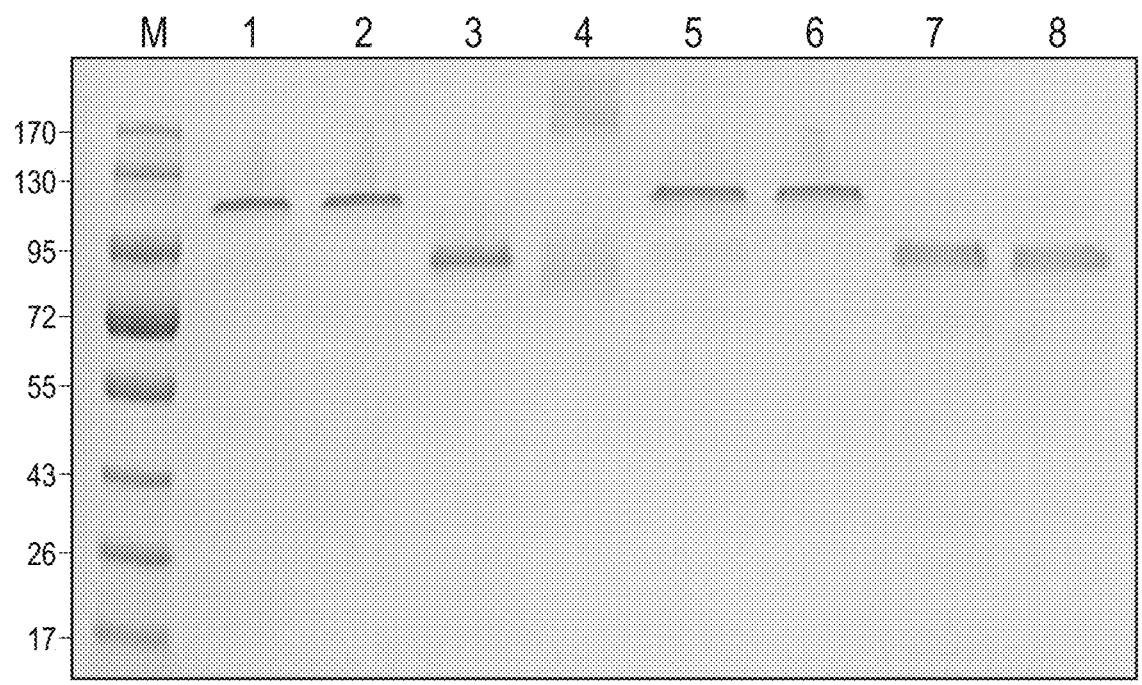
FIG. 42 is a photograph of a 10% SDS-PAGE of EeGUS and the EeQ8C/S73C variant enzyme showing the stability of BGUS enzymes in the presence of non-reducing conditions, reducing conditions, heat or combinations of each.

To examine the stability of the EeQ8C/S73C variants as compared to the parental EeGUS enzyme (template), the enzymes were subjected to various conditions that could affect enzyme stability. FIG. 42 shows the results of a 10% SDS-PAGE showing the stability of EeQ8C/S73C over template. The molecular weight marker lane is labeled with an "M". Lanes 1 and 2 were subjected to non-reducing conditions where lane 1 is template and lane 2 is EeQ8C/S73C. Lanes 3 and 4 were subjected to non-reducing conditions and heated at 100° C. for 10 minutes where lane 3 is template and lane 4 is EeQ8C/S73C. Lanes 5 and 6 were subjected to reducing conditions with 50 mM reducing agent Tris(2-carboxyethyl)phosphine (TCEP) where lane 5 was template and lane 6 was EeQ8C/S73C. Lanes 7 and 8 were subjected to reducing conditions with 50 mM reducing agent TCEP and heated at 100° C. for 10 minutes where lane 7 was template and lane 8 was EeQ8C/S73C. Each lane contained about 0.7 µg of protein.

Figure 41:
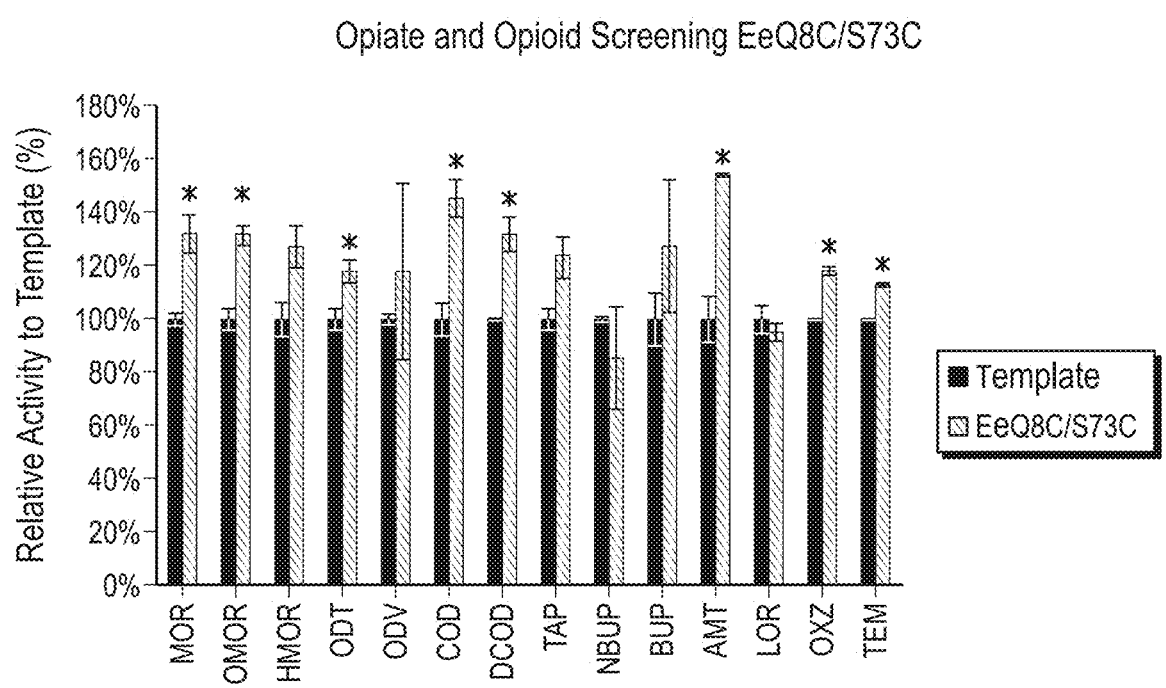
FIG. 41 is a bar graph showing the enzymatic activity of the variant EeQ8C/S73C on a panel of opiate and opioid substrates.

In summary, the results from FIGS. 40, 41 and 42 demonstrate that the following EeGUS cysteine variants exhibited enhanced stability and/or enhanced enzymatic activity against at least one, and often multiple, substrates as compared to the template from which the variant was derived: EeQ8C/S73C, EeK588C and EeP489C/Q570C, the amino acid sequences of which are shown in SEQ ID NOs: 118-120.

EQUIVALENTS

Those skilled in the art will recognize, or be able to ascertain using no more than routine experimentation, many equivalents of the specific embodiments of the invention described herein. Such equivalents are intended to be encompassed by the following claims.

SUMMARY OF SEQUENCE LISTING

| SEQ ID NO: | DESCRIPTION |
|---|---|
| 1 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASHDSSKKTIDTYKLATGIRTVKVQGTQFLINDKP<br>FYFTGFGKHEDTNIRGKGHDDAYMVHDFQLLHWMGANSFRTSHYPYAEEVMEYAD<br>RQGIVVIDETPAVGLAFSIGAGAQTSNPPATFSPDRINNKTREAHAQAHRELIHRDKNH<br>PSVVMWSHANEPASNEDGAREYFAPLPKLARQLDPTRPVTFANVGLATYKADRHADL<br>FDVLCLNRYFGWYTQTAELDEAEAALEEELRGWTEKYDKPIVMTEYGADTVAGLHS<br>VMVTPWSEEFQVEMLDMYHRVFDRFEAMAGEQVWNFADFQTAVGVSRVDGNKKG<br>VFTRDRKPKAAAHLLRKRWTNLHNGTAEGSKTFQ<br>(AoGUS G600S: *Aspergillus oryzae* BGUS) |
| 2 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDSAVRGKGYDPAYMVHDFQLMDVVMGANSFRTSHYPYAEEVMEF<br>ADRHGIVVIDETPAVGLAFSIGSGVSSEDSPQTFTPEGINNNTREAHKQAIRELIARDK<br>NHASWMWSIANEPASQEVGAREYFAPLVDLAHELDPSRPVCFANYGDATYEVDRIS<br>DMFDVLCLNRYFGWYSQTGEVEEAEAALEKELLGWEGKYGKPIVITEYGADTMAGLH<br>SVLALPWSEEFQVQLLDMYHRVFDRIDSVVGEHVWNFADFQTAVGIIRVDGNKKGVF<br>TRERKPKAAAHTLKTRWSGMLGSDH<br>(AtGUS: *Aspergillus terreus* BGUS) |
| 3 | MKKLLAAAMLFMLNSWSCFSADTPRAEYPRPQFEREQWVNLNGTWTFDFDFGKSG<br>KDRRLQSAEKFDKNITVPFCPESKLSGVGYTDFIEQMWYQRNITIPSDWNGKKIFLNF<br>GAVDYCAEIYVDGKFVQRHFGGSSSFAVDLTRYVTPGKTHNLVVFVQDDLRSGLQTGG<br>KQCGNYYSGGCSYTRTTGIWQTVWMEAVSADGLKSVFVRPDIDQKQLVIEPEFYNES<br>ANTLEITLKDRNKTVAKKSVNCANSSVWLPVKNMKLWSPEDPFLYDLVYQVKDAK<br>GNVLDEVKSYAGMRKVHTANGRFYLNNQPYFQRLVLDQGFYPEGIWTAPSDEDLKN<br>DIVLGKEAGFNGARLHQKVFEERYYYWADKLGYITWGESASWMLDVNKELAARNFL<br>GEWSEWVRDRNHPSLVTWTPFNETWGGGPDAYIRLVRDVYNITKAIDPTRPVNDA<br>SGDNHVITDIWSVHNYEQDRAKLTEQLKMEEGKEPYRNARDKDFLAVYEGQPYMVD<br>EFGGIPWMAEKDRKNSWGYGGMPENAEAFYKRLEGQIDAFIDSPHVTGFCYTQLTDV<br>EQEKNGIYYYDRTPKLDMKRIKAIFEKIK<br>(BfGUS: *Bacteroides fragilis* BGUS) |

SUMMARY OF SEQUENCE LISTING

| SEQ ID NO: | DESCRIPTION |
|---|---|
| 4 | MKTLLKNSLTFLLMLMPVLAFAQQAPQIMNVSARQTTSLDGQWKTIVDPFENGYYD YRLKPYDGGYAQDKTYSDKTKLQEYDFETDKLLFVPGDWNTQRPQLYYYEGTVWYR KHFEYSLQPGKRLFLNFGAVNYEAIVWLNGKRLGRHIGGFTPFNFEITNLLKEGTNSL VVKVDNKRLPEAVPTVNADWWNFGGITRPVTLIEMPATYIRDYYVQLAKDDKNMIE GWVQLEGSDKEQKITLDIPELKVKKEVTTDANGYASFLIKSKPILWTPENPKLYAVNL ASETDKVSDEIGFRTIRTEGIKILLNDKEIFCRGISIHEETPYYSGRAYSKDHAHTLLSW AKELGCNFVRLAHYPHNEEMVREAERMGFLVWSEIPVYWTIHWENKDTYQNAEQQ LCDMIARDKNRCNIIIWSIANETPHSETRLTFLSNLANKARSLDSVRLIGAAMEKEEVQ PGVLTVNDPLGELLDIISFNEYVGWYDGDSEKCDRVNWTFDTQKPVFISELGGGALYG RHGSPKERFTEEYQEDLYIRHVNMLKRIPGLAGTTPWILKDFRSPRRHVPEIQDDFNR KGLVSDKGQKKKAFFVLQKWYKELTEAYK<br>(BuGUS: *Bacteroides uniformis* BGUS) |
| 5 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAIQASSPGKCKCMHL CDVITLNRYYGWYFLGGYEIDMSEEKFREEMNLYSNMNKPVMFTEYGADTYAGVHK LPSVMWSEEYQCEYYEMNFKVFDSYDFIVGEQLWNFADFQTTEGIFRVDGNKKGIFT RNRQPKAVAHLIRSRWNKLPLDYKSKK<br>(BpGUS: *Brachyspira pilosicoli* BGUS) |
| 6 | MVNSMLYPRESRTRRVVDISGMWEFKIDSNNEGRKNGYANGLKDTTFIPVPSSFNDL FTDKNIREHAGDIWYETSFYLPLEWKDKNVIRFGCATHEAAVYINGKEVCTHVGGF MPFNAPVNEAGIFGEKNKLWWNNELSNTTLPCGHTETKPSGKKYIKPSFDFFNYAG LNRPVKITVTNKEYIYDIDILSDINGSDGIVNYEVHTTGENKVFVKIYDEEGKEAASAEG KNGKIVIKNAKLWNPKAAYLYKFEACIKNGEELIDEYYLDFGIRTIKVEGTKFLINGKP FYFTGFGKHEDSETAGRGYNPPVIKRDFELIKWIGANSFRTSHYPYSEEIMQAADREGI VIIDEIAAVGMFDVGSVLNPGASKADYFSLEEVHTKTKEIHKKAVEELITRDKNHPSVV MWSLFNEPDTSKDEALPYFEDIFNFAKSIDKQNLPKTFAAIQASAPGKCKCMHLCDVI TLNRYYGWYFLGGYEIDMSEEKFREEMNLYKDMNKPVMFTEYGADTYAGVHKLPSV MWSEEYQCEYYEMNFKVFDSYDFIIGEQLWNFADFQTTEGIFRVDGNKKGIFTRTRQ PKAVAHYIRSRWTKLPLDYKK<br>(BmGUS: *Brachyspira murdochii* BGUS) |
| 7 | MLYPIITESRQLIDLSGIWKFKLNEGNGLTEELSKAPLEDTIEMAVPSSYNDLVESQEV RDHVGWVWYERNFTIPKTLLNERIVLRFGSATHEAKVYLNGELLVEHKGGFTPFEAE INDLLVSGDNRLTVAVNNIIDETTLPVGLVKEVEVDGKKVIKNSVNFDFFNYAGIHRPV KIYTTPKSYIEDITIVTDFKENNGYVNYEVQAVGKCNIKVTIIDEENNIVAEGEGKEGKL TINNVHLWEPMNAYLYKLKVELLDDEEIIDTYFEEFGVRTVEVKDGKFLINNKPFYFK GFGKHEDSYVNGRGINEAINIKDFNLMKWIGANSFRTSHYPYSEEIMRLADREGIVVID ETPAVGLHLNFMATGFGGDAPKRDTWKEIGTKEAHERILRELVSRDKNHPCWMWS VANEPDSDSEGAKEYFEPLIKLTKELDPQKRPVTWTYLMSTPDRCKVGDIVDVLCLN RYYGWYVAGGDLEEAKRMLEDELKGWEERCPKTPIMFTEYGADTVAGLHDTVPVM FTEEYQVEYYKANHEVMDKCKNFVGEQVWNFADFATSQGIIRVQGNKKGIFTRERKP KMIAHSLRERWTNIPEFGYKK<br>(CpGUS: *Clostridium perfringens* BGUS) |
| 8 | MLRPVETPTREIKKLDGLWAFSLDRENCGIDQRWWESALQESRAIAVPGSFNDQFAD ADIRNYAGNVWYQREVFIPKGWAGQRIVLRFDAVTHYGKVWVNNQEVMEHQGGYT PFEADVTPYVIAGKSVRITVCVNNELNWQTIPPGMVITDENGKKKQSYFHDFFNYAGI HRSVMLYTTPNTWVDDITVVTHVAQDCNHASVDWQVVANGDVSVELRDADQQWA TGQGTSGTLQVVNPHLWQPGEGYLYELCVTAKSQTECDIYPLRVGIRSVAVKGEQFLI NHKPFYFTGFGRHEDADLRGKGFDNVLMVHDHALMDWIGANSYRTSHYPYAEEML DWADEHGIVVIDETAAVGFNLSLGIGFEAGNKPKELYSEEAVNGETQQAHLQAIKELI ARDKNHPSVVMWSVANEPDTRPQGAREYFAPLAEATRKLDPTRPVTCVNVMFCDAH TDTISDLFDVLCLNRYYGWYVQSGDLETAEKVLEKELLAWQEKLHQPHITEYGVDTL AGLHSMYTDMWSEEYQCAWLDMYHRVFDRVSAVVGEQVWNFADFATSQGVLRVGG NKKGIFTRDRKPKSAAFLLQKRWTGMNFGEKPQQGGKQ<br>(EcGUS: *Escherichia coli* BGUS) |
| 9 | MLRPVETPTREIKKLDGLWAFSLDRENCGIDQRWWESALQESRAIAVPGSFNDQFAD ADIRNYAGNVWYQREVFIPKGWAGQRIVLRFDAVTHYGKVWVNNQEVMEHQGGYT PFEADVTPYVIAGKSVRITVCVNNELNWQTIPPGMVITDENGKKKQSYFHDFFNYAGI HRSVMLYTTPNTWVDDITVVTHVAQDCNHASVDWQVVANGDVSVELRDADQQVVA TGQGTSGTLQVVNPHLWQPGEGYLYELCVTAKSQTECDIYPLRVGIRSVAVKGEQFLI NHKPFYFTGFGRHEDADLRGKGFDNVLMVHDHALMDWIGANSYRTSHYPYAEEML DWADEHGIVVIDETAAVGFNLSLGIGFEAGNKPKELYSEEAVNGETQQAHLQAIKELI ARDKNHPSVVMWSIANEPDTRPQGAREYFAPLAEATRKLDPTRPITCVNVMFCDAH |

| SUMMARY OF SEQUENCE LISTING | |
|---|---|
| SEQ ID NO: | DESCRIPTION |
| | TDTISDLFDVLCLNRYYGWYVQSGDLETAEKVLEKELLAWQEKLHQPIIITEYGVDTL<br>AGLHSMYTDMWSEEYQCAWLDMYHRVFDRVSAVVGEQVWNFADFATSQSILRVGG<br>NKKGIFTRDRKPKSAAFLLQKRWTGMNFGEKPQQGSKQGLCGR<br>(EcE1F: IMCSzyme variant *Escherichia coli* K12 BGUS) |
| 10 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeGUS: *Eubacterium eligens* BGUS) |
| 11 | MARGSAVAWAALGPLLWGCALGLQGGMLYPQESPSRECKELDGLWSFRADFSDNRR<br>RGFEEQWYRRPLWESGPTVDMPVPSSFNDISQDWRLRHFVGWVWYEREVILPERW<br>TQDLRTRVVLRIGSAHSYAIVWVNGVDTLEHEGGYLPFEADISNLVQVCPLPSRLRITI<br>AINNTLTPTTLPPGTIQYLTDTSKYPKGYFVQNTYFDFFNYAGLQRSVLLYTTPTTYID<br>DITVTTSVEQDSGLVNYQISVKGSNLFKLEVRLLDAENKWANGTGTQGQLKVPGVSL<br>WWPYLMHERPAYLYSLEVQLTAQTSLGPVSDFYTLPVGIRTVAVTKSQFLINGKPYF<br>HGVNKHEDADIRGKGFDWPLLVKDFNLLRWLGANAFRTSHYPYAEEVMQMCDRYG<br>IVVIDECPGVGLALPQFFNNVSLHHHMQVMEEWRRDKNHPAWMWSVANEPASHL<br>ESAGYYLKMVIAHTKSLDPSRPVTFVSNSNYAADKGAPYVDVICLNSYYSWYHDYGHL<br>ELIQLQLATQFENWYKKYQKPIIQSEYGAETIAGFHQDPPLMFTEEYQKSLLEQYHLG<br>LDQKRRKYVVGELIWNFADFMTEQSPTRVLGNKKGIFTRQRQPKSAAFLLRERYWKI<br>ANETRYPHSVAKSQCLENSLFT<br>(HsGUS: *Homo sapiens* BGUS) |
| 12 | MLYPMETASRVVLDLSGVWRFMIDKEQIPVDVTRPLPATLSMAVPASFNDQTASKEI<br>REHVGYVWYERCFELPQLLRQERLVLRFGSATHEAWVYLNGHLITHHKGGFTPFEVE<br>INDDLVTGENRLTVKLSNMLDYTTLPVGHYKETQNETGQRVRQLDENFDFFNYAGL<br>QRPVKIYSTPHSYIRDITLTPKVNLTNHSAWNGEIETVGDVEQVVVTILDEDNQVVGT<br>TSGKTLAIELNSVHLWQPGKAYLYRAKVELYQAGQVIDTYIETFGIRQIAVKAGKFLIN<br>GQPFYFKGFGKHEDAYIHGRGLSEPQNVLDLSLMKQMGANSFRTSHYPYSEEMMRLC<br>DREGIVVIDEVPAVGLMLSFTFDVSALEKDDFEDDTWEKLRTAEAHRQAITEMIDRD<br>KNHASVVMWSISNEAANFSKGAYEYFKPLFDLARKLDPQQRPCTYTSIMMTTLKTDR<br>CLALADVIALNRYYGYVYMGNGDLKAAETATREELLAYQAKFPDKPIMYTEYGADTIA<br>GLHSNYDEPFSEEFQEDYYRMCSRVFDEVTNFVGEQLWNFADFQTKFGIQRVQGNKK<br>GIFTRAREPKMVVRYLTQRWRNIPDFNYKK<br>(LbLR2D: *Lactobacillus brevis* BGUS) |
| 13 | MSLKWSACWVALGQLLCSCALALKGGMLFPKESPSRELKALDGLWHFRADLSNNRL<br>QGFEQQWYRQPLRESGPVLDMPVPSSFNDITQEAALRDFIGWVWYEREAILPRRWT<br>QDTDMRWLRINSAHYYAVVWVNGIHWEHEGGHLPFEADISKLVQSGPLTTCRITIA<br>INNTLTPHTLPPGTIVYKTDTSMYPKGYFVQDTSFDFFNYAGLHRSWLYTTPTTYID<br>DITVITNVEQDIGLVTYWISVQGSEHFQLEVQLLDEGGKVVAHGTGNQGQLQVPSANL<br>WWPYLMHEHPAYMYSLEVKVTTTESVTDYYTLPIGIRTVAVTKSKFLINGKPFYFQG<br>VNKHEDSDIRGKGFDWPLLVKDFNLLRWLGANSFRTSHYPYSEEVLQLCDRYGIVVID<br>ECPGVGIVLPQSFGNESLRHHLEVMEELVRRDKNHPAVVMWSVANEPSSALKPAAYY<br>FKTLITHTKALDLTRPVTFVSNAKYDADLGAPYVDVICVNSYFSWYHDYGHLEVIQPQ<br>LNSQFENWYKTHQKPIIQSEYGADAIPGIHEDPPRMFSEEYQKAVLENYHSVLDQKRK<br>EYVVGELIWNFADFMTNQSPLRVIGNKKGIFTRQRQPKTSAFILRERYWRIANETGGH<br>GSGPRTQCFGSRPFTF<br>(*Mus musculus* BGUS) |
| 14 | MKRISIAFLSLFLCVASVWSMPRPEYPRPQFERAGWVNLNGEWTCSFDFGGSGMERE<br>FYKSKGFDKKITVPFCPESKLSGIGYTDFINHFWYQRPITIPQEWNGKNILLNFGAVYY<br>KSEVYIDGVLASRHFGGTSSFAVDITSLVKPGQTHSLVVYVESDVRGAKQAAGKQNLQ<br>YASYGCNYTRTTGIWQTVWMEAVHPEGLQSIQLLTDIDQQQLWRPRFYKEAGGKLQ<br>VTLKDNGKWASRTVSASSLSSVVLPVKKMKTWSPESPFLYDLEYKVLDKNGNIIDEV<br>NGYAGMRKVHIEGNKIYLNNKPYYQRLVLPQGFYPDGIWTAPSDEALKRDIELSMEA<br>GFNGARLHQKVFEERFYYWADKMGYLTWGEASSWGMDCNDTETARNFITEWSEIV<br>QRDRNHPSLLIWTPTNEEFWPDRVQYPRLMHDLYNLTKMIDPTRPFHGASGGTHIA<br>TDIWTVHNYEQDPAKLKEKLYNGGKLMEAPKWEIHLMPMNIGYNGLKYTDQYAFPE<br>YKKDMPYLVDEFGGIKWNPSQQMESAQNTSWGYGEPPRSLEEFYARLEGQVDAVLS<br>LSNDIWGYCYTQLTDVEQEQNGIYYYDRTPKFDMKRIHAIFSKTPESK<br>(PmGUS: *Parabacteroides sp. merdae* BGUS) |

SUMMARY OF SEQUENCE LISTING

| SEQ ID NO: | DESCRIPTION |
|---|---|

15  MLYPINTETRGVFDLNGVWNFKLDYGKGLEEKWYESKLTDTISMAVPSSYNDIGVTK
    EIRNHIGYVWYEREFTVPAYLKDQRIVLRFGSATHKAIVYVNGELVVEHKGGFLPFEA
    EINNSLRDGMNRVTVAVDNILDDSTLPVGLYSERHEEGLGKVIRNKPNFDFFNYAGLH
    RPVKIYTTPFTYVEDISVVTDFNGPTGTVTYTVDFQGKAETVKVSVVDEEGKVVASTE
    GLSGNVEIPNVILWEPLNTYLYQIKVELVNDGLTIDVYEEPFGVRTVEVNDGKFLINNK
    PFYFKGFGKHEDTPINGRGFNEASNVMDFNILKWIGANSFRTAHYPYSEELMRLADR
    EGLVVIDETPAVGVHLNFMATTGLGEGSERVSTWEKIRTFEHHQDVLRELVSRDKNH
    PSVVMWSIANEAATEEEGAYEYFKPLVELTKELDPQKRPVTIVLFVMATPETDKVAE
    LIDVIALNRYNGWYFDGGDLEAAKVHLRQEFHAWNKRCPGKPIMITEYGADTVAGFH
    DIDPVMFTEEYQVEYYQANHVVFDEFENFVGEQAWNFADFATSQGVMRVQGNKKG
    VFTRDRKPKLAAHVFRERWTNIPDFGYKN
    (StpGUS: *Staphylococcus* sp. RLH1 BGUS)

16  MLYPLLTKTRNTYDLGGIWNFKLGEHNPNELLPSDEVMVIPTSFNDLMVSKEKRDYI
    GDFWYEKVIEVPKVSEGEEMVLRFGSVTHQAKIYVDGILVGEHKGGFTPFEVLVPECK
    YNNEKIKVSICANNVLDYTTLPVGNYSEIIQEDGSIKKKVRENFDFFNYAGVHRPLKLM
    IRPKNHISDITITSRLSDDLQSADLHFLVETNQKVDEVRISVFDEDNKLVGETKDSRLF
    LSDVHLWEVLNAYLYTARVEIFVDNQLQDVYEENFGLREIEVTNGQFLLNRKPIYFKG
    FGKHEDTFINGRGLNEAANLMDLNLLKDIGANSFRTSHYPYSEEMMRLADRMGVLVI
    DEVPAVGLFQNFNASLDLSPKDNGTWSLMQTKAAHEQAIQELVKRDKNHPSVVMW
    VVANEPASHEAGAHDYFEPLVKLYKDLDPQKRPVTLVNILMATPDRDQVMDLVDW
    CLNRYYGWYVDHGDLTNAEVGLRKELLEWQDKFPDKPIIITEYGADTLPGLHSTWNI
    PYTEEFQCDFYEMSHRVFDGIPNLVGEQVWNFADFETNLMILRVQGNHKGLFSRNR
    QPKQVVKEFKKRWMTIPHYHNKKNSVK
    (SaGUS: *Streptococcus agalactiae* BGUS)

17  MLKPRQTPFRDLISLDGLWKFALDSGDNATAAPWTGPLTTDLECPVPASYNDIFVDR
    QIRDHVGWVYYQREAIVPRAWSQQQYLVRVDAATHQGRIYINDNLVAEHRGGYTPFE
    ADITGLVSAGDSFRLTIAVNNELTHETIPPGRIEVEEYTGKRVQVYQHDFFNYAGLARS
    VWLYSVPQQHIQDIKWTHVKGSAGLINYLVTVSNSTTGRVKIDVIDKDGTTVAEASG
    ARGSVTIDSVKLWQPGEAYLYQFRASIVGLNDSVVDTYCVETGVRTVKVSGNRFLIND
    KPFYFTGFGKHEDTNIRGKGHDDAYMVHDFQLLHWMGANSFRTSHYPYAEEVMEY
    ADRQGIVVIDETPAVGLAFSIGAGAQTSNPPATFSPDRINNKTREAHAQAIRELIHRDK
    NHPSVVMWSIANEPASNEDGAREYFAPLPKLARQLDPTRPVTFANVGLATYKADRIA
    DLFDVLCLNRYFGWYTQTAELDEAEAALEEELRGWTEKYDPIVMTEYGADTVAGL
    HSVMVTPWSEEFQVEMLDMYHRVFDRFEAMAGEQVWNFADFQTAVGVSRVDGNK
    KGVFTRDRKPKAAAHLLRKRWTNLHNGTAEGSKTFQ
    (Rxn1 chimera)

18  MLKPRQTPFRDLISLDGLWKFALDSGDNATAAPWTGPLTTDLECPVPASYNDIFVDR
    QIRDHVGWVYYQREAIVPRAWSQQQYLVRVDAATHQGRIYINDNLVAEHRGGYTPFE
    ADITGLVSAGDSFRLTIAVNNELTHETIPPGRIEVEEYTGKRVQVYQHDFFNYAGLARS
    VWLYSVPQQHIQDIKWTHVKGSAGLINYLVTVSNSTTGRVKIDVIDKDGTTVAEASG
    ARGSVTIDSVKLWQPGEAYLYQFRASIVGLNDSVVDTYCVETGVRTVKVSGNRFLIND
    KPFYFTGFGRHEDADLRGKGFDNVLMVHDHALMDWIGANSYRTSHYPYAEEMLDW
    ADEHGIVVIDETAAVGFNLSLGIGFEAGNKPKELYSEEAVNGETQQAHLQAIKELIARD
    KNHPSVVMWSIANEPDTRPQGAREYFAPLAEATRKLDPTRPITCVNVMFCDAHTDTI
    SDLFDVLCLNRYYGWYVQSGDLETAEKVLEKELLAWQEKLHQPIIITEYGVDTLAGLH
    SMYTDMWSEEYQCAWLDMYHRVFDRVSAWGEQVWNFADFATSQSILRVGGNKKG
    IFTRDRKPKSAAFLLQKRWTGMNFGEKPQQGSKTFQ
    (Rxn2 chimera)

19  MLKPQQTTTRDLISLDGLWKFALASDDNNTQPWTSQLKTSLECPVPASYNDIFADSK
    IHDHVGWVYYQRDVIVPKGWSEERYLVRCEAATHHGRIYVNGNLVADHVGGYTPFE
    ADITDLVAAGEQFRLTIAVDNELTYQTIPPGKVEILEATGKKVQTYQHDFYNYAGLAR
    SVWLYSVPQQHIQDITVRTDVQGTTGLIDYNVVASTTQGTIQVAVIDEDGTTVATSSGS
    NGTIHIPSVHLVVQPGAAYLYQLHASIIDSSKKTIDTYKLATGIRTVKVQGTQFLINDKP
    FYFTGFGKHEDSAVRGKGYDPAYMVHDFQLMDWMGANSFRTSHYPYAEEVMEFAD
    RHGIVVIDETPAVGLAFSIGSGVSSEDSPQTFFTPEGINNNTREAHKQAIRELIARDKNH
    ASVVMWSIANEPASQEVGAREYFAPLVDLAHELDPSRPVCFANYGDATYEVDRISDM
    FDVLCLNRYFGWYSQTGEVEEAEAALEKELLGWEGKYGKPIVITEYGADTMAGLHSV
    LALPWSEEFQVQLLDMYHRVFDRIDSVVGEHVWNFADFQTAVGIIRVDGNKKGVFTR
    ERKPKAAAHTLKTRWSGMLGSDH
    (Rxn3 chimera)

20  MLKPRQTPFRDLISLDGLWKFALDSGDNATAAPWTGPLTTDLECPVPASYNDIFVDR
    QIRDHVGWVYYQREAIVPRAWSQQQYLVRVDAATHQGRIYINDNLVAEHRGGYTPFE
    ADITGLVSAGDSFRLTIAVNNELTHETIPPGRIEVEEYTGKRVQVYQHDFFNYAGLARS
    VWLYSVPQQHIQDIKVVTHVKGSAGLINYLVTVSNSTTGRVKIDVIDKDGTTVAEASG
    ARGSVTIDSVKLWQPGEAYLYQFRASIVGLNDSVVDTYCVETGVRTVKVSGNRFLIND
    KPFYFTGFGRHEDADLRGKGFDNVLMVHDHALMDWIGANSYRTSHYPYAEEMLDW
    ADEHGIVVIDETAAVGFNLSLGIGFEAGNKPKELYSEEAVNGETQQAHLQAIKELIARD

SUMMARY OF SEQUENCE LISTING

| SEQ ID NO: | DESCRIPTION |
|---|---|
| | KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSDH<br>(Rxn4 chimera) |
| 21 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETAAVGFNLSLGIGFEAGNKPKELYSEEAVNGETQQAHLQAIKELIARD<br>KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSKQGLCGR<br>(Rxn5 chimera) |
| 22 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETAAVGFNLSLGIGFEAGNKPKELYSEEAVNGETQQAHLQAIKELIARD<br>KNHPSVVMWSIANEPDTRPQGAREYFAPLAEATRKLDPTRPITCVNVMFCDAHTDTI<br>SDLFDVLCLNRYYGWYVQSGDLETAEKVLEKELLAWQEKLHQPIIITEYGVDTLAGLH<br>SMYTDMWSEEYQCAWLDMYHRVFDRVSAVVGEQVWNFADFATSQSILRVGGNKKG<br>IFTRDRKPKSAAFLLQKRWTGMNFGEKPQQGSKQGLCGR<br>(Rxn8 chimera) |
| 23 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITWTHVAQDCNHASVDWQVVANGDVSVELRDADQQVVA<br>TGQGTSGTLQWNPHLWQPGEGYLYELCVTAKSQTECDIYPLRVGIRSVAVKGEQFLI<br>NHKPFYFTGFGKHEDTNIRGKGHDDAYMVHDFQLLHWMGANSFRTSHYPYAEEVM<br>EYADRQGIWIDETPAVGLAFStGAGAQTSNPPATFSPDRINNKTREAHAQAIRELIHR<br>DKNHPSVVMWSIANEPASNEDGAREYFAPLPKLARQLDPTRPVTFANVGLATYKAD<br>RIADLFDVLCLNRYFGWYTQTAELDEAEAALEEELRGWTEKYDKPIVMTEYGADTVA<br>GLHSVMVTPWSEEFQVEMLDMYHRVFDRFEAMAGEQVWNFADFQTAVGVSRVDG<br>NKKGVFTRDRKPKAAAHLLRKRWTNLHNGTAEGSKQGLCGR<br>(Rxn9 chimera) |
| 24 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITWTHVAQDCNHASVDWQWANGDVSVELRDADQQVVA<br>TGQGTSGTLQVVNPHLWQPGEGYLYELCVTAKSQTECDIYPLRVGIRSVAVKGEQFLI<br>NHKPFYFTGFGKHEDSAVRGKGYDPAYMVHDFQLMDWMGANSFRTSHYPYAEEVM<br>EFADRHGIWIDETPAVGLAFSIGSGVSSEDSPQTFTPEGINNNTREAHKQAIRELIARD<br>KNHASVVMWSIANEPASQEVGAREYFAPLVDLAHELDPSRPVCFANYGDATYEVDRI<br>SDMFDVLCLNRYFGWYSQTGEVEEAEAALEKELLGWEGKYGKPIVITEYGADTMAGL<br>HSVLALPWSEEFQVQLLDMYHRVFDRIDSWGEHVWNFADFQTAVGIIRVDGNKKGV<br>FTRERKPKAAAHTLKTRWSGMLGSKQGLCGR<br>(Rxn10 chimera) |
| 25 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDSAVRGKGYDPAYMVHDFQLMDWMGANSFRTSHYPYAEEVMEF<br>ADRHGIVVIDETPAVGLAFSIGSGVSSEDSPQTFTPEGINNNTREAHKQAIRELIARDK<br>NHASVVMWSIANEPASNEDGAREYFAPLPKLARQLDPTRPVTFANVGLATYKADRIA<br>DLFDVLCLNRYFGWYTQTAELDEAEAALEEELRGWTEKYDKPIVMTEYGADTVAGL<br>HSVMVTPWSEEFQVEMLDMYHRVFDRFEAMAGEQVWNFADFQTAVGVSRVDGNK<br>KGVFTRDRKPKAAAHLLRKRWTNLHNGTAEGSKTFQ<br>(Save1 chimera) |
| 26 | MLKPQQTTTRDLISLDGLWKFALASDDNNTQPWTSQLKTSEECPVPASYNDIFADSK<br>IHDHVGWVYYQRDVIVPKGWSEERYLVRCEAATHHGRIYVNGNLVADHVGGYTPFE |

| SEQ ID NO: | DESCRIPTION |
|---|---|
| | ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQPLINDKP<br>FYFTGFGKHEDTNIRGKGHDDAYMVHDFQLLHWMGANSFRTSHYPYAEEVMEYAD<br>RQGIVVIDETPAVGLAFSIGAGAQTSNPPATFSPDRINNKTREAHAQAIRELIHRDKNH<br>PSVVMVVSIANEPASQEVGAREYFAPLVDLAHELDPSRPVCFANYGDATYEVDRISDM<br>FDVLCLNRYFGWYSQTGEVEEAEAALEKELLGWEGKYGKPIVITEYGADTMAGLHSV<br>LALPVVSEEFQVQLLDMYHRVFDRIDSVVGEHVWNFADFQTAVGIIRVDGNKKGVFTR<br>ERKPKAAAHTLKTRWSGMLGSDH<br>(Save3 chimera) |
| 27 | MLKPRQTPFRDLISLDGLWKFALDSCDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRETIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETPAVGLAFSIGSGVSSEDSPQTFTPEGINNNTREAHKQAIRELIARDK<br>NHASVVMWSIANEPDTRPQGAREYFAPLAEATRKLDPTRPITCVNVMFCDAHTDTIS<br>DLFDVLCLNRYYGWYVQSGDLETAEKVLEKELLAWQEKLHQPIIITEYGVDTLAGLHS<br>MYTDMWSEEYQCAWLDMYHRVFDRVSAWGEQVWNFADFATSQSILRVGGNKKGI<br>FTRDRKPKSAAFLLQKRWTGMNFGEKPQQGSDH<br>(Save4 chimera) |
| 28 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGRHEDADLRGKGFDNVLMVHDHALMDWIGANSYRTSHYPYAEEMLDW<br>ADEHGIVVIDETPAVGLAFSIGAGAQTSNPPATFSPDRINNKTREAHAQAIRELIHRDK<br>NHPSVVMWSIANEPDTRPQGAREYFAPLAEATRKLDPTRPITCVNVMFCDAHTDTIS<br>DLFDVLCLNRYYGWYVQSGDLETAEKVLEKELLAWQEKLHQPIIITEYGVDTLAGLHS<br>MYTDMWSEEYQCAWLDMYHRVFDRVSAWGEQVWNFADFATSQSILRVGGNKKGI<br>FTRDRKPKSAAFLLQKRWTGMNFGEKPQQGSKQGLCGR<br>(Save5 chimera) |
| 29 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQWANGDVSVELRDADQQVVA<br>TGQGTSGTLQVVNPHLVVQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETAAVGFNLSLGIGFEAGNKPKELYSEEAVNGETQQAHLQAIKELI<br>ARDKNHPSVVMWSIANEPASNEDGAREYFAPLPKLARQLDPTRPVTFANVGLATYK<br>ADRIADLFDVLCLNRYFGWYTQTAELDEAEAALEEELRGWTEKYDKPIVMTEYGADT<br>VAGLHSVMVTPWSEEFQVEMLDMYHRVFDRFEAMAGEQVWNFADFQTAVGVSRV<br>DGNKKGVFTRDRKPKAAAHLLRKRWTNLHNGTAEGSKQGLCGR<br>(Save9 chimera) |
| 30 | MLRPVETPTREIKKLDGLWAFSLDRENCGIDQRWWESAIQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGII<br>HRSVMLYTTPNTWVDDITVVTHVAQDCNHASVDWQWANGDVSVELRDADQQVVA<br>TGQGTSGTLQVVNPHLWQPGEGYLYELCVTAKSQTECDIYPLRVGIRSVAVKGEQFLI<br>NHKPFYFTGFGKHEDSAVRGKGYDPAYMVHDFQLMDWMGANSFRTSHYPYAEEVM<br>EFADRHGIVVIDETAAVGFNLSLGIGFEAGNKPKELYSEEAVNGETQQAHLQAIKELIA<br>RDKNHPSVVMWSIANEPASQEVGAREYFAPLVDLAHELDPSRPVCFANYGDATYEVD<br>RISDMFDVLCLNRYFGWYSQTGEVEEAEAALEKELLGWEGKYGKPIVITEYGADTMA<br>GLHSVLALPWSEEFQVQLLDMYHRVFDRIDSVVGEHVWNFADFQTAVGIIRVDGNKK<br>GVFTRERKPKAAAHTLKTRWSGMLGSKQGLCGR<br>(Save10 chimera) |
| 31 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQPLINDKP<br>FYFTGFGKHEDTNIRGKGHDDAYMVHDFQLLHWMGANSFRTSHYPYAEEVMEYAD<br>RQGIVVIDETPAVGLAFSIGSGVSSEDSPQTFTPEGINNNTREAHKQAIRELIARDKNH<br>ASVVMWSIANEPASNEDGAREYFAPLPKLARQLDPTRPVTFANVGLATYKADRIADL |

SUMMARY OF SEQUENCE LISTING

| SEQ ID NO: | DESCRIPTION |
|---|---|
| | FDVLCLNRYFGWYTQTAELDEAEAALEEELRGWTEKYDKPIVMTEYGADTVAGLHS<br>VMVTPWSEEFQVEMLDMYHRVFDRFEAMAGEQVWNFADFQTAVGVSRVDGNKKG<br>VFTRDRKPKAAAHLLRKRWTNLHNGTAEGSKTFQ<br>(L1 chimera) |
| 32 | MLKPQQTTTRDLISLDGLWKFALASDDNNTQPWTSQLKTSLECPVPASYNDIFADSK<br>IHDHVGWVYYQRDVIVPKGWSEERYLVRCEAATMHGRIYVNGNLVADMVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGRHEDADLRGKGFDNVLMVHDHALMDWIGANSYRTSHYPYAEEMLDWAD<br>EHGIVVIDETAAVGFNLSLGIGFEAGNKPKELYSEEAVNGETQQAHLQAIKELIARDKN<br>HPSVVMWSIANEPASNEDGAREYFAPLPKLARQLDPTRPVTFANVGLATYKADRIAD<br>LFDVLCLNRYFGWYTQTAELDEAEAALEEELRGWTEKYDKPIVMTEYGADTVAGLH<br>SVMVTPWSEEFQVEMLDMYHRVFDRFEAMAGEQVWNFADFQTAVGVSRVDGNKK<br>GVFTRDRKPKAAAHLLRKRWTNLHNGTAEGSKTFQ<br>(L2 chimera) |
| 33 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDTNIRGKGHDDAYMVHDFQLLHWMGANSFRTSHYPYAEEVMEY<br>ADRQGIVVIDETPAVGLAFSIGAGAQTSNPPATFSPDRINNKTREAHAQAIRELIHRDK<br>NHPSVVMWSIANEPASQEVGAREYFAPLVDLAHELDPSRPVCFANYGDATYEVDRIS<br>DMFDVLCLNRYFGWYSQTGEVEEAEAALEKELLGWEGKYGKPIVITEYGADTMAGLH<br>SVLALPWSEEFQVQLLDMYHRVFDRIDSVVGEHVWNFADFQTAVGIIRVDGNKKGVF<br>TRERKPKAAAHTLKTRWSGMLGSDH<br>(L3 chimera) |
| 34 | MLKPRQTPFRDLISLDGLWKFALDSGDNATAAPWTGPLTTDLECPVPASYNDIFVDR<br>QIRDHVGWVYYQREAIVPRAWSQQQYLVRVDAATHQGRIYINDNLVAEHRGGYTPFE<br>ADITGLVSAGDSFRLTIAVNNELTHETIPPGRIEVEEYTGKRVQVYQHDFFNYAGLARS<br>VWLYSVPQQHIQDIKVVTHVKGSAGLINYLVTVSNSTTGRVKIDVIDKDGTTVAEASG<br>ARGSVTIDSVKLWQPGEAYLYQFRASIVGLNDSVVDTYCVETGVRTVKVSGNRFLIND<br>KPFYFTGFGKHEDSAVRGKGYDPAYMVHDFQLMDWMGANSMEF<br>ADRHGIVVIDETAAVGFNLSLGIGFEAGNKPKELYSEEAVNGETQQAHLQAIKELIARD<br>KNHPSVVMWSIANEPASQEVGAREYFAPLVDLAHELDPSRPVCFANYGDATYEVDRI<br>SDMFDVLCLNRYFGWYSQTGEVEEAEAALEKELLGWEGKYGKPIVITEYGADTMAGL<br>HSVLALPWSEEFQVQLLDMYHRVFDRIDSWGEHVWNFADFQTAVGIIRVDGNKKGV<br>FTRERKPKAAAHTLKTRWSGMLGSDH<br>(L4 chimera) |
| 35 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEAPVTPYVIAGKSVRITVCVNNELNWQTIPPGMVITDENGKKKQSYFHPFFNYAGI<br>HRSVMLYTTPNTWVDDITVVTHVAQDCNHASVDWQWANGDVSVELRDADQQVVA<br>TGQGTSGTLQVVNPHLWQPGEGYLYELCVTAKSQTECDIYPLRVGIRSVAVKGEQFLI<br>NHKPFYFTGFGKHEDTNIRGKGHDDAYMVHDFQLLHWMGANSFRTSHYPYAEEVM<br>EYADRQGIVVIDETPAVGLAFSIGAGAQTSNPPATFSPDRINNKTREAHAQAIRELIHR<br>DKNHPSVVMWSIANEPDTRPQGAREYFAPLAEATRKLDPTRPITCVNVMFCDAHTD<br>TISDLFDVLCLNRYYGWYVQSGDLETAEKVLEKELLAWQEKLHQPIIITEYGVDTLAG<br>LHSMYTDMWSEEYQCAWLDMYHRVFDRVSAVVGEQVWNFADFATSQSILRVGGNK<br>KGIFTRDRKPKSAAFLLQKRWTGMNFGEKPQQGSKQGLCGR<br>(L5 chimera) |
| 36 | MLRPVETPTREIKKLDGLWAFSLDRENCGIDQRWWESALQESRAIAVPGSFNDQFAD<br>ADIRNYAGNVWYQREVFIPKGWAGQRIVLRFDAVTHYGKVWVNNQEVMEHQGGYT<br>PFEADVTPYVIAGKSVRITVCVNNELNWQTIPPGMVITDENGKKKQSYFHDFFNYAGI<br>HRSVMLYTTPNTWVDDITVVTHVAQDCNHASVDWQWANGDVSVELRDADQQVVA<br>TGQGTSGTLQVVNPHLWQPGEGYLYELCVTAKSQTECDIYPLRVGIRSVAVKGEQFLI<br>NHKPFYFTGFGRHEDADLRGKGFDNVLMVHDHALMDWIGANSYRTSHYPYAEEML<br>DWADEHGIVVIDETPAVGLAFSIGSGVSSEDSPQTFTPEGINNNTREAHKQAIRELIAR<br>DKNHASVVMWSIANEPDTRPQGAREYFAPLAEATRKLDPTRPITCVNVMFCDAHTD<br>TISDLFDVLCLNRYYGWYVQSGDLETAEKVLEKELLAWQEKLHQPIIITEYGVDTLAG<br>LHSMYTDMWSEEYQCAWLDMYHRVFDRVSAWGEQVWNFADFATSQSILRVGGNK<br>KGIFTRDRKPKSAAFLLQKRWTGMNFGEKPQQGSKQGLCGR<br>(L6 chimera) |
| 37 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGGKANMMSGMMGGMGAGASDK |

| SEQ ID NO: | DESCRIPTION |
|---|---|
| | PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDVGSVLNPSASKTDYFSLDEVHSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>G1FRVDGNKKGIFTRNRQPKAVAHLIRSRWNKLPLDYKSKK<br>(BpChimera1 chimera) |
| 38 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDQFGGGANFGGERIGTFDKEHGSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpChimera2 chimera) |
| 39 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGGKANMMSGMMGGMGAGASDK<br>PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDQFGGGANFGGERIGTFDKEHGSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>GIFRVDGNKKGIFTRNRQPKAVAHLIRSRWNKLPLDYKSKK<br>(BpChimera3 chimera) |
| 40 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGGGGANFGGERDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpChimera4 chimera) |
| 41 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGGKANMMSGMMGGMGAGASDK<br>PQNNPNFDFFNYAGLNRPVKITVTNKEYIHDIDILSDVNGSDGIVNYEVHTTGENKVYI<br>KINDEEGKEVASCEGKSGKIVIKDAKLWNPKAAYLYKFIACIKNGDELIDEYYLDFGIR<br>TVKVEGTKFLINGKPFYFTGFGKHEDSEIAGRGYNPPVIKRDFELIKWVGANSFRTSHY<br>PYSEEIMQAADREGIVIIDEVAAVGMFDVGGGGANFGGERDYFSLDEVHSKTKEVHKK<br>AVEELIKRDKNHPSVVMWSLFNEPDTSKDEAVPYFEDIFNFAKSQDKQNLPKTFAAI<br>QASSPGKCKCMHLCDVITLNRYYGWYFLGGYEIDMSEEKFREEMNLYSNMNKPVMF<br>TEYGADTYAGVHKLPSVMWSEEYQCEYYEMNFKVFDSYDFIVGEQLWNFADFQTTE<br>GIFRVDGNKKGIFTRNRQPKAVAHLIRSRWNKLPLDYKSKK<br>(BpChimera5 chimera) |
| 42 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLFVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKWQHANSFRTSHYPYSEEMMRLCDE<br>EGIWIDETTAVGVNLQFGGGANFGGERIGTFDKEHGVQTQEHHKDVIRDLISRDKNH<br>ACVVMWSIANEPDSAAEGAYDYFKPLYDLARELDPQKRPCTLVSVQGTTADTDCSSQ<br>LSDVICLNRYYGWYFGGPDLEVSEIGLRKELSDWGKLGKPVMFTEYGADTVSGLHDT |

SUMMARY OF SEQUENCE LISTING

| SEQ ID NO: | DESCRIPTION |
|---|---|
| | TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera1 chimera) |
| 43 | MLYPVLTQSRLLSDLSGVWDFKLDNGKGFEEKWYEKPLKDADTMPVPASYNDLKEC<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLVGSVLNPSASKTDYFSLDEVHVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFWGEQAWNFADFATSQSL<br>LRVQGNKKGLFTRDRKPKMVAHYFRNRWSTIPEFGYKTK<br>(EeChimera2 chimera) |
| 44 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKWQHANSFRTSHYPYSEEMMRLCDE<br>EGIVVIDETTAVGVNLVGSVLNPSASKTDYFSLDEVHVQTQEHHKDVIRDLISRDKNH<br>ACVVMWSIANEPDSAAEGAYDYFKPLYDLARELDPQKRPCTLVSVQGTTADTDCSSQ<br>LSDVICLNRYYGWYFGGPDLEVSEIGLRKELSDWGKLGKPVMFTEYGADTVSGLHDT<br>TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera3 chimera) |
| 45 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFSVLNPSASKTIGTFDKEHGVQTQEHHKD<br>VIRDLISRDKNHACVVMWSIANEPDSAAEGAYDYFKPLYDLARELDPQKRPCTLVSVQ<br>GTTADTDCSSQLSDVICLNRYYGWYFGGPDLEVSEIGLRKELSDWGKLGKPVMFTEYG<br>ADTVSGLHDTTSVMYTEEYQVEYYEMNNKVFDEFDFWGEQAWNFADFATSQSLLR<br>VQGNKKGLFTRDRKPKMVAHYFRNRWSTIPEFGYKTK<br>(EeChimera4 chimera) |
| 46 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGCGHTETKPSGKKYIKPSFDFFNYCGITRP<br>VKIYTTPETYINDITVTADIDFTKEEPSAVLNYNVEIKGKDYNNITCKVELFDEEGTKLS<br>ETEGSEGTFEISNVRLWQPLNAYLYKIKVTAGQDVYTLPYGVRSVRVDGTKFLINEKP<br>FYFKGYGKHEDTFPNGRGINLPMNTKDISIMKVVQHANSFRTSHYPYSEEMMRLCDE<br>EGIVVIDETTAVGVNLQFSVLNPSASKTIGTFDKEHGVQTQEHHKDVIRDLISRDKNH<br>ACVVMWSIANEPDSAAEGAYDYFKPLYDLARELDPQKRPCTLVSVQGTTADTDCSSQ<br>LSDVICLNRYYGWYFGGPDLEVSEIGLRKELSDVVGKLGKPVMFTEYGADTVSGLHDT<br>TSVMYTEEYQVEYYEMNNKVFDEFDFVVGEQAWNFADFATSQSLLRVQGNKKGLFT<br>RDRKPKMVAHYFRNRWSTIPEFGYKTK<br>(EeChimera5 chimera) |
| 47 | MVNSMLYPRESRTRRVVDISGMWEFKIDINNEGRNSGYANGLKDTTFIPVPSSFNDLF<br>TDKNIREHAGDVWYETSFYLPLEWDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYATGFGKHEDSEIAGRGYNPPVIKRDFELIKWGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294A) |
| 48 | MVNSMLYPRESRTRRVVDISGMWEFKIDINNEGRNSGYANGLKDTTFIPVPSSFNDLF<br>TDKNIREHAGDVWYETSFYLPLEWDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE |

SUMMARY OF SEQUENCE LISTING

| SEQ ID NO: | DESCRIPTION |
|---|---|
| | GKSGKIVIKDAKLWNPKAAYLYKFIACIKNGDELIDEYYLDFGIRTVKVEGTKFLINGK<br>PFYITGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpF294I) |
| 49 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYVTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294V) |
| 50 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMVVSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y) |
| 51 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYLTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294L) |
| 52 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYWTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294W) |
| 53 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGDVYTLPYGVRSV<br>RVDGTKFLINEKPFYWKGYGKHEDTFPNGRGINLPMNTKDISIMKWQHANSFRTSH<br>YPYSEEMMRLCDEEGIVVIDETTAVGVNLQFGGGANFGGERIGTFDKEHGVQTQEHH<br>KDVIRDLISRDKNHACVVMWSIANEPDSAAEGAYDYFKPLYDLARELDPQKRPCTLV<br>SVQGTTADTDCSSQLSDVICLNRYYGWYFGGPDLEVSEIGLRKELSDWGKLGKPVMFT<br>EYGADTVSGLHDTTSVMYTEEYQVEYYEMNNKVFDEFDFWGEQAWNFADFATSQS<br>LLRVQGNKKGLFTRDRKPKMVAHYFRNRWSTIPEFGYKTK<br>(EeF303W) |

SUMMARY OF SEQUENCE LISTING

| SEQ ID NO: | DESCRIPTION |
|---|---|
| 54 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGPLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYSKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICINRYYGWYFGGPDLEVSEIGLRKELSDWGKLGKPVMFTE<br>YGADTVSGLHDTTSVMYTEEYQVEYYEMNNKVFDEFDFWGEQAWNFADFATSQSL<br>LRVQGNKKGLFTRDRKPKMVAHYFRNRWSTIPEFGYKTK<br>(EeF303S) |
| 55 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPGGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFAGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295A) |
| 56 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFCGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMVVSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295C) |
| 57 | MVNSMLYPRESRTRRVVDISGMVVEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFFGFGKMEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295F) |
| 58 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFIGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpT295I) |
| 59 | MVNSMLYPRESRTRRVVDISGMWEFKIDINNEGRNSGYANGLKDTTFIPVPSSFNDLF<br>TDKNIREHAGDVWYETSFYLPLEVVKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYKGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP |

SUMMARY OF SEQUENCE LISTING

| SEQ ID NO: | DESCRIPTION |
|---|---|
| | SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRVVNKLPLDYKSKK<br>(BpT295K) |
| 60 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFSGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRVVNKLPLDYKSKK<br>(BpT295S) |
| 61 | MVNSMLYPRESRTRRVVDISGMWEFKIDINNEGRNSGYANGLKDTTFIPVPSSFNDLF<br>TDKNIREHAGDVWYETSFYLPLEVVKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLVVNFADFQTTEGIFRVDGNKKGIFT<br>RNRQPKAVAHLIRSRWNKLPLDYKSKK<br>(BpT295V) |
| 62 | MLYPVLTQSRLLSDLSGVWDFKLDNGKGFEEKWYEKPLKDADTMPVPASYNDLKEG<br>TDFRDHYGVWFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFAGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFWGEQAWNFADFATSQSL<br>LRVQGNKKGLFTRDRKPKMVAHYFRNRWSTIPEFGYKTK<br>(EeK304A) |
| 63 | MLYPVLTQSRLLSDLSGVWDFKLDNGKGFEEKWYEKPLKDADTMPVPASYNDLKEG<br>TDFRDHYGVWFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFVGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNMACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeK304V) |
| 64 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLWWNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAFQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpI450F) |
| 65 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF |

SUMMARY OF SEQUENCE LISTING

| SEQ ID NO: | DESCRIPTION |
|---|---|
|  | MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAKQASSPGKCKCMHL CDVITLNRYYGWYFLGGYEIDMSEEKFREEMNLYSNMNKPVMFTEYGADTYAGVHK LPSVMWSEEYQCEYYEMNFKVFDSYDFIVGEQLVVNFADFQTTEGIFRVDGNKKGIFT RNRQPKAVAHLIRSRWNKLPLDYKSKK (BpI450K) |
| 66 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVHDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAALQASSPGKCKCMHL CDVITLNRYYGWYFLGGYEIDMSEEKFREEMNLYSNMNKPVMFTEYGADTYAGVHK LPSVMWSEEYQCEYYEMNFKVFDSYDFIVGEQLWNFADFQTTEGIFRVDGNKKGIFT RNRQPKAVAHLIRSRWNKLPLDYKSKK (BpI450L) |
| 67 | MVNSMLYPRESRTRRVVDISGMWEFKIDINNEGRNSGYANGLKDTTFIPVPSSFNDLF TDKNIREHAGDVWYETSFYLPLEVVKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAMQASSPGKCKCMH LCDVITLNRYYGWYFLGGYEIDMSEEKFREEMNLYSNMNKPVMFTEYGADTYAGVH KLPSVMWSEEYQCEYYEMNFKVFDSYDFIVGEQLWNFADFQTTEGIFRVDGNKKGIF TRNRQPKAVAHLIRSRWNKLPLDYKSKK (BpI450M) |
| 68 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAQQASSPGKCKCMHL CDVITLNRYYGWYFLGGYEIDMSEEKFREEMNLYSNMNKPVMFTEYGADTYAGVHK LPSVMWSEEYQCEYYEMNFKVFDSYDFIVGEQLWNFADFQTTEGIFRVDGNKKGIFT RNRQPKAVAHLIRSRWNKLPLDYKSKK (BpI450Q) |
| 69 | MVNSMLYPRESRTRRVVDISGMWEFKIDINNEGRNSGYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVNNELSNTTIPCGHTETKPSGKKYIKPSFDFFNYAG LNRPVKITVTNKEYIHDIDISDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFEHKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAADQASSPGKCKCMHL CDVITLNRYYGWYFLGGYEIDMSEEKFREEMNLYSNMNKPVMFTEYGADTYAGVHK LPSVMWSEEYQCEYYEMNFKVFDSYDFIVGEQLWNFADFQTTEGIFRVDGNKKGIFT RNRQPKAVAHLIRSRWNKLPLDYKSKK (BpI450D) |
| 70 | MVNSMLYPRESRTRRVVDISCMWEFKIDINNEGRNSCYANGLKDTTFIPVPSSFNDLF TDKNIREHAGDVWYETSFYLPLEWKDKDVNVRFGCATHEATVYINGKEVCTHVGGF MPFNAPVNEAGIFGEKNKLVVVVNNELSNTTIPCGHTETKPSGKKYIKPSFDFFNYAG LNRPVKITVTNKEYIHDIDILSDVNGSDGIVNYEVHTTGENKVYIKINDEEGKEVASCE GKSGKIVIKDAKLWNPKAAYLYKFIACIKNGDELIDEYYLDFGIRTVKVEGTKFLINGK PFYFTGFGKHEDSEIAGRGYNPPVIKRDFELIKWVGANSFRTSHYPYSEEIMQAADRE GIVIIDEVAAVGMFDVGSVLNPSASKTDYFSLDEVHSKTKEVHKKAVEELIKRDKNHP SVVMWSLFNEPDTSKDEAVPYFEDIFNFAKSQDKQNLPKTFAAVQASSPGKCKCMHL CDVITLNRYYGWYFLGGYEIDMSEEKFREEMNLYSNMNKPVMFTEYGADTYAGVHK |

-continued

SUMMARY OF SEQUENCE LISTING

| SEQ ID NO: | DESCRIPTION |
|---|---|
| | LPSVMWSEEYQCEYYEMNFKVFDSYDFIVGEQLWNFADFQTTEGIFRVDGNKKGIFT RNRQPKAVAHLIRSRWNKLPLDYKSKK (BpI450V) |
| 71 | MLYPVLTQSRLLSDLSGVWDFKLDNGKGFEEKWYEKPLKDADTMPVPASYNDLKEG TDFRDHYGVWFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSF QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459F) |
| 72 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSL QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459L) |
| 73 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVS WQGTTADTDCSSQLSDVICLNRYYGWYFGGPDLEVSEIGLRKELSDWGKLGKPVMFT EYGADTVSGLHDTTSVMYTEEYQVEYYEMNNKVFDEFDFWGEQAVVNFADFATSQS LLRVQGNKKGLFTRDRKPKMVAHYFRNRWSTIPEFGYKTK (EeV459W) |
| 74 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVSC QGTTADTDCSSQLSDVICLNRYYGWYFGGPDLEVSEIGLRKELSDWGKLGKPVMFTE YGADTVSGLHDTTSVMYTEEYQVEYYEMNNKVFDEFDFVVGEQAWNFADFATSQSL LRVQGNKKGLFTRDRKPKMVAHYFRNRWSTIPEFGYKTK (EeV459C) |
| 75 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC KVELFDEEGTKLSETEGSEGTFEISNVRLWQPLNAYLYKIKVTAGQDVYTLPYGVRSV RVDGTKFLINEKPFYFKGYGKHEDTFPNGRGINLPMNTKDISIMKWQHANSFRTSHY PYSEEMMRLCDEEGIVVIDETTAVGVNLQFGGGANFGGERIGTFDKEHGVQTQEHHK DVIRDLISRDKNHACVVMWSIANEPDSAAEGAYDYFKPLYDLARELDPQKRPCTLVS GQGTTADTDCSSQLSDVICLNRYYGWYFGGPDLEVSEIGLRKELSDWGKLGKPVMFT EYGADTVSGLHDTTSVMYTEEYQVEYYEMNNKVFDEFDFWGEQAWNFADFATSQS LLRVQGNKKGLFTRDRKPKMVAHYFRNRWSTIPEFGYKTK (EeV459G) |
| 76 | MLYPVLTQSRLLSDLSGVWDFKLDNGKGFEEKWYEKPLKDADTMPVPASYNDLKEG TDFRDHYGWVFYQRNISVPEYVKSQRIVLRCAAVTHYAMIYLNGKLICEHKGGFLPFE VELNDDLQDGDNLLTIAVNNVIDYTTLPVGGKANMMSGMMGGMGAGASDKPQNNP NFDFFNYCGITRPVKIYTTPETYINDITVTADIDFTKEEPSAVLNYNVEIKGKDYNNITC |

-continued

SUMMARY OF SEQUENCE LISTING

| SEQ ID NO: | DESCRIPTION |
|---|---|
| | KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSE<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFPFVVGEQAWNFADFATSQSL<br>LRVQGNKKGLFTRDRKPKMVAHYFRNRWSTIPEFGYKTK<br>(EeV459E) |
| 77 | MVNSMLYPRESRTRRVVDISGMWEFKIDINNEGRNSGYANGLKDTTFIPVPSSFNDLF<br>TDKNIREHAGDVWYETSFYLPLEWKDKIWNVRFGCATHEATVYINGKEVCTHVGGF<br>MPFNAPVNEAGIFGEKNKLVVVVNNELSNTFIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVINEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVEIKKAVEELIKRDKNHP<br>SVVMWSLFNEPDTSKDEAVPYFEDIFNFAKSQDKQNLPKTFAAIDASSPGKCKCMHL<br>CDVITLNRYYGWYFLGGYEIDMSEEKFREEMNLYSNMNKPVMFTEYGADTYAGVHK<br>LPSVMWSEENCEYYEMNFIKVFDSYDFIVGEQLWNFADFQTTEGIFRVDGNKKGIFT<br>RNRQPKAVAHLIRSRWNKLPLDYKSKK<br>(BpQ451D) |
| 78 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIFIDIDILSDVNGSDGIVNYEVIITTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSITNEPDTSKDEAVPYFEDIFNFAKSQDKQLPKTFAAIEASSPGKCKCMHL<br>CDVITLNRYYGWYFLGGYEIDMSEEKFREEMNLYSNMNKRVMFTEYGADTYAGVHK<br>LPSVMWSEENCEYYEMNFKVFDSYDFIVGEQLWNFADFQTTEGIFRVDGNKKGIFT<br>RNRQPKAVAHLIRSRWNKLPLDYKSKK<br>(BpQ451E) |
| 79 | MVNSMLYPRESRTRRVVDISGMWEFKIDINNEGRNSGYANGLKDTTFIPVPSSFNDLF<br>TDKNIREFIAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTFGENKVYIKINDEEGKEVASCE<br>GKSGKIVIKDAKLWNPKAAYINKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNIIP<br>SVVMWSLFNEPDTSKDEAVPYFEDIFNFAKSQDKOLPKTFAAIGASSPGKCKCMHL<br>CDVITLNRYYGWYFLGGYEIDMSEEKFREEMNLYSNMNKPVIVIFTEYGADTYAGVHK<br>LPSVMWSEENCEYYEMNFINFDSYDFIVGEQLWNFADFQTTEGIFRVDGNKKGIFT<br>RNRQPKAVAHLIRSRWNKLPLDYKSKK<br>(BpQ451G) |
| 80 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNIRPVKITVTNKEYIHDIDILSDVNGSDGIVNYEVHTTGENKVYIKINDEEGKEVASCE<br>GKSGKIVIKDAKLWNPKAAYINKFIACIKNGDELIDEYYLDFGIRTVKVEGTKFLINGK<br>PFYFTGIGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAISASSPGKCKCMHLC<br>DVITLNRYYGWYFLGGYEIDNISEEKFREEMNLYSNMNKPVIAFTEYGADTYAGVHKL<br>PSVMWSEENCEYNTIVINFKVFDSYDFIVGEQLWNFADFQTTEGIFRVDGNKKGIFTR<br>NRQPKAVAHLIRSRWNKLPLDYKSKK<br>(BpQ451S) |
| 81 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLVVNPKAAYLYKFIACIKNGDELIDEYYLDPGIRTVKVEGTKFLINGK<br>PFYFTGFGKHEDSEIAGRGYNPPVIKRDFELIKINVGANSFRTSHYPYSEEIMQAADRE<br>GIVIIDEVAAVGNIFDVGSVIAPSASKTDYFSLDEVHSKTKEVHKKAVEELIKRDKNHP<br>SVVMWSLFNEPDTSKDEAVPYFEDIFNFAKSQDKQNLPKTFAAIVASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451V) |

| SUMMARY OF SEQUENCE LISTING |
|---|

| SEQ ID NO: | DESCRIPTION |
|---|---|
| 82 | MVNSMLYPRESRTRRVVDISGMWEFKIDINNEGRNSGYANGLKDTTFIPVPSSFNDLF<br>TDKNIREHAGDVINYETSFYLPLEWKDKIWNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIKASSPGKCKCMHL<br>CDVITLNRYYGWYEIGGYEIDMSEEKFREEMNLYSNMNKPVNIFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451K) |
| 83 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGNIFDVGSVLNPSASKTDYFSLDEVHSKTKEVHKKAVEELIKRDKNHP<br>SVVIVIWSITNEPDTSKDEAVPYFEDIFNFAKSQDKOLPKTFAAIQDSSPGKCKCMHL<br>CDVITLNRYYGWYFLGGYEIDMSEEKFREEMNLYSNIANKRVMFTEYGADTYAGVHK<br>LPSVMWSEENCEYYEMNFKVFDSYDFIVGEQLWNFADFQTTEGIFRVDGNIKKGIFT<br>RNRQPKAVAIILIRSRWNKLPLDYKSKK<br>(BpA452D) |
| 84 | MVNSMLYPRESRTRRVVDISGMWEFKIDINNEGRNSGYANGLKDTTFIPVPSSFNDLP<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKIAVNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQKSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452K) |
| 85 | MVNSMLYPRESRTRRVVDISGMWEFKIDINNEGRNSGYANGLKDTTFIPVPSSFNDLF<br>TDKNIREHAGDVWYETSFYLPLEVVKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQNSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452N) |
| 86 | MVNSMLYPRESRTRRVVDISGMWEFKIDINNEGRNSGYANGLKDTTFIPVPSSFNDLF<br>TDKNIREHAGDVYVYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>ENRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQGSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLYVNFADFQTTEGIFRVDGNKKGIFT<br>RNRQPKAVAHLIRSRWNKLPLDYKSKK<br>(BpA452G) |
| 87 | MVNSMLYPRESRTRRVVDISGMWEFKIDINNEGRNSGYANGLKDTTFIPVPSSFNDLF<br>TDKNIREHAGDVWYETSFYLPLEVVKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP |

SUMMARY OF SEQUENCE LISTING

| SEQ ID NO: | DESCRIPTION |
|---|---|
| | SVVMWSLFNEPDTSKDEAVPYFEDIFNFAKSQDKQNLPKTFAAIQESSPGKCKCMHL<br>CDVITLNRYYGWYFLGGYEIDMSEEKFREEMNLYSNMNKPVMFTEYGADTYAGVHK<br>LPSVMYVSEEYQCEYYEMNFKVFDSYDFIVGEQLWNFADFQTTEGIFRVDGNKKGIFT<br>RNRQPKAVAHLIRSRWNKLPLDYKSKK<br>(BpA452E) |
| 88 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKNDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQQSSPGKCKCMML<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpA452Q) |
| 89 | MLYPVLTQSRLLSDLSGVWDFKLDNGKGFEEKYVYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QATTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461A) |
| 90 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QHTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461H) |
| 91 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VEENDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QNTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeG461N) |
| 92 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QSTTADTDCSSQLSDVICLNRYYGWYFGGPDLEVSEIGLRKELSDWGKLGKPVMFTEY<br>GADTVSGLHDTTSVMYTEEYQVEYYEMNNKVFDEFDFWQEQAWNFADFATSQSLL<br>RVQGNKKGLFTRDRKPKMVAHYFRNRWSTIPEFGYKTK<br>(EeG461S) |
| 93 | MVNSMLYPRESRTRRVVDISGMWEFKIDINNEGRNSGYANGLKDTTFIPVPSSFNDLF<br>TDKNIREHAGDVWYETSFYLPLEVVKDKDVNVRFGCATHEATVYINGKEVCTHVGGF |

SUMMARY OF SEQUENCE LISTING

| SEQ ID NO: | DESCRIPTION |
|---|---|
| | MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLVVNFADFQTTEEIFRVDGNKKGIFT<br>RNRQPKAVAHLIRSRWNKLPLDYKSKK<br>(BpG563E) |
| 94 | MVNSMLYPRESRTRRWDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEAIFRVDGNKKGIFT<br>RNRQPKAVAHLIRSRWNKLPLDYKSKK<br>(BpG563A) |
| 95 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEDIFRVDGNKKGIFT<br>RNRQPKAVAHLIRSRWNKLPLDYKSKK<br>(BpG563D) |
| 96 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEYIFRVDGNKKGIFT<br>RNRQPKAVAHLIRSRWNKLPLDYKSKK<br>(BpG563Y) |
| 97 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQGL<br>LRVQGNKKGLFTRDRKPKMVAHYFRNRWSTIPEFGYKTK<br>(EeS571G) |
| 98 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE |

SUMMARY OF SEQUENCE LISTING

| SEQ ID NO: | DESCRIPTION |
|---|---|
| | YGADTVSGLHDTTSVMYTEEYQVEYYEMNNKVFDEFDFVVGEQAWNFADFATSQNL<br>LRVQGNKKGLFTRDRKPKMVAHYFRNRWSTIPEFGYKTK<br>(EeS571N) |
| 99 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAACEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDVVMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVVIIRVDGNKKGVFTR<br>ERKPKAAAHTLKTRWSGMLGSDH<br>(Rxn3G560V) |
| 100 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIWIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGDATYEVDRISDM<br>FDVLCLNRYFGWYSQTGEVEEAEAALEKELLGVVEGKYGKPIVITEYGADTMAGLHSV<br>LALPWSEEFQVQLLDMYHRVFDRIDSVVGEHVWNFADFQTAVEIIRVDGNKKGVFTR<br>ERKPKAAAHTLKTRWSGMLGSDH<br>(Rxn3G560E) |
| 101 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYCGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295C) |
| 102 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYIGFGKHEDSEIAGRGYNPPVIKRDFELIKWVGANSFRTSHYPYSEEIMQAADREG<br>IVIIDEVAAVGMFDVGSVLNPSASKTDYFSLDEVHSKTKEVHKKAVEELIKRDKNHPS<br>VVMWSLFNEPDTSKDEAVPYFEDIFNFAKSQDKQNLPKTFAAIQASSPGKCKCMHLC<br>DVITLNRYYGWYFLGGYEIDMSEEKFREEMNLYSNMNKPVMFTEYGADTYAGVHKL<br>PSVMWSEEYQCEYYEMNFKVFDSYDFIVGEQLWNFADFQTTEGIFRVDGNKKGIFTR<br>NRQPKAVAHLIRSRWNKLPLDYKSKK<br>(BpF294Y/T29SI) |
| 103 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295V) |
| 104 | MVNSMLYPRESRTRRVVDISGMWEFKIDINNEGRNSGYANGLKDTTFIPVPSSFNDLF<br>TDKNIREHAGDVWYETSFYLPLEWWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE |

SUMMARY OF SEQUENCE LISTING

| SEQ ID NO: | DESCRIPTION |
|---|---|
| | GKSGKIVIKDAKLWNPKAAYLYKFIACIKNGDELIDEYYLDFGIRTVKVEGTKFLINGK<br>PFYYFGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295F) |
| 105 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYMGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpF294Y/T295M) |
| 106 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYYKGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLVVNFADFQTTEGIFRVDGNKKGIFT<br>RNRQPKAVAHLIRSRWNKLPLDYKSKK<br>(BpF294Y/T295K) |
| 107 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAALQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V/I450L) |
| 108 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAMQASSPGKCKCMH<br>LCDVITLNRYYGWYFLGGYEIDMSEEKFREEMNLYSNMNKPVMFTEYGADTYAGVH<br>KLPSVMWSEEYQCEYYEMNFKVFDSYDFIVGEQLWNFADFQTTEGIFRVDGNKKGIF<br>TRNRQPKAVAHLIRSRWNKLPLDYKSKK<br>(BpT295V/I450M) |
| 109 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKINDEEGKEVASCE<br>GKSGKIVIKDAKLWNPKAAYLYKFIACIKNGDELIDEYYLDFGIRTVKVEGTKFLINGK<br>PFYFVGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAYQASSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpT295V/I450Y) |

| SUMMARY OF SEQUENCE LISTING | |
|---|---|
| SEQ ID NO: | DESCRIPTION |

110  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFVGFGKHEDSEIAGRGYNPPVIKRDFELIKWVGANSFRTSHYPYSEEIMQAADRE
GIVIIDEVAAVGMFDVGSVLNPSASKTDYFSLDEVHSKTKEVHKKAVEELIKRDKNHP
SVVMWSLFNEPDTSKDEAVPYFEDIFNFAKSQDKQNLPKTFAAVQASSPGKCKCMHL
CDVITLNRYYGWYFLGGYEIDMSEEKFREEMNLYSNMNKPVMFTEYGADTYAGVHK
LPSVMWSEEYQCEYYEMNFKVFDSYDFIVGEQLVVNFADFQTTEGIFRVDGNKKGIFT
RNRQPKAVAHLIRSRWNKLPLDYKSKK
(BpT295V/I450V)

111  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFTGFGKHEDSEIAGRGYNPPVIKRDFELIKWVGANSFRTSHYPYSEEIMQAADRE
GIVHDEVAAVGMFDVGSVLNPSASKTDYFSLDEVHSKTKEVHKKAVEELIKRDKNHP
SVVMWSLFNEPDTSKDEAVPYFEDIFNFAKSQDKQNLPKTFAAMDASSPGKCKCMH
LCDVITLNRYYGWYFLGGYEIDMSEEKFREEMNLYSNMNKPVMFTEYGADTYAGVH
KLPSVMWSEEYQCEYYEMNFKVFDSYDFIVGEQLWNFADFQTTEGIFRVDGNKKGIF
TRNRQPKAVAHLIRSRWNKLPLDYKSKK
(BpI450M/Q451D)

112  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFTGFGKHEDSEIAGRGYNPPVIKRDFELIKWVGANSFRTSHYPYSEEIMQAADRE
GIVIIDEVAAVGMFDVGSVLNPSASKTDYFSLDEVHSKTKEVHKKAVEELIKRDKNHP
SVVMWSLFNEPDTSKDEAVPYFEDIFNFAKSQDKQNLPKTFAAQDASSPGKCKCMHL
CDVITLNRYYGWYFLGGYEIDMSEEKFREEMNLYSNMNKPVMFTEYGADTYAGVHK
LPSVMWSEEYQCEYYEMNFKVFDSYDFIVGEQLWNFADFQTTEGIFRVDGNKKGIFT
RNRQPKAVAHLIRSRWNKLPLDYKSKK
(Bp1450Q/Q451D)

113  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFTGFGKHEDSEIAGRGYNPPVIKRDFELIKWVGANSFRTSHYPYSEEIMQAADRE
GIVIIDEVAAVGMFDVGSVLNPSASKTDYFSLDEVHSKTKEVHKKAVEELIKRDKNHP
SVVMWSLFNEPDTSKDEAVPYFEDIFNFAKSQDKQNLPKTFAAIDESSPGKCKCMHL
CDVITLNRYYGWYFLGGYEIDMSEEKFREEMNLYSNMNKPVMFTEYGADTYAGVHK
LPSVMWSEEYQCEYYEMNFKVFDSYDFIVGEQLWNFADFQTTEGIFRVDGNKKGIFT
RNRQPKAVAHLIRSRWNKLPLDYKSKK
(BpQ451D/A452E)

114  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFTGFGKHEDSEIAGRGYNPPVIKRDFELIKWVGANSFRTSHYPYSEEIMQAADRE
GIVIIDEVAAVGMFDVGSVLNPSASKTDYFSLDEVHSKTKEVHKKAVEELIKRDKNHP
SVVMWSLFNEPDTSKDEAVPYFEDIFNFAKSQDKQNLPKTFAAIDGSSPGKCKCMHL
CDVITLNRYYGWYFLGGYEIDMSEEKFREEMNLYSNMNKPVMFTEYGADTYAGVHK
LPSVMWSEEYQCEYYEMNFKVFDSYDFIVGEQLWNFADFQTTEGIFRVDGNKKGIFT
RNRQPKAVAHLIRSRWNKLPLDYKSKK
(BpQ451D/A452G)

115  MVNSMLYPRESRTRRVVDISGMWEFKIDINNEGRNSGYANGLKDTTFIPVPSSFNDLF
TDKNIREHAGDVWYETSFYLPLEWKDKDVNVRFGCATHEATVYINGKEVCTHVGGF
MPFNAPVNEAGIFGEKNKLVVVVNNELSNTTIPCGHTETKPSGKKYIKPSFDFFNYAG
LNRPVKITVTNKEYIHDIDILSDVNGSDGIVNYEVHTTGENKVYIKINDEEGKEVASCE
GKSGKIVIKDAKLWNPKAAYLYKFIACIKNGDELIDEYYLDFGIRTVKVEGTKFLINGK
PFYFTGFGKHEDSEIAGRGYNPPVIKRDFELIKWVGANSFRTSHYPYSEEIMQAADRE
GIVIIDEVAAVGMFDVGSVLNPSASKTDYFSLDEVHSKTKEVHKKAVEELIKRDKNHP

| SEQ ID NO: | DESCRIPTION |
|---|---|
| | SVVMWSLFNEPDTSKDEAVPYFEDIFNFAKSQDKQNLPKTFAAIDQSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452Q) |
| 116 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKNDEEGKEVASCE<br>GKSGKIVIKDAKLWNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDSSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLVVNFADFQTTEGIFRVDGNKKGIFT<br>RNRQPKAVAHLIRSRWNKLPLDYKSKK<br>(BpQ451D/A452S) |
| 117 | MVNSMLYPRESRTRRVVDISGMWEFKIDINNEGRNSGYANGLKDTTFIPVPSSFNDLF<br>TDKNIREHAGDVWYETSFYLPLEWKDKDVNVRFGCATHEATVYINGKEVCTHVGGF<br>MPFNAPVNEAGIFGEKNKLVVVVNNELSNTTIPCGHTETKPSGKKYIKPSFDFFNYAG<br>LNRPVKITVTNKEYIHDIDILSDVNGSDGIVNYEVHTTGENKVYIKNDEEGKEVASCE<br>GKSGKIVIKDAKLVVNPKAAYLYKFIACIKNGDELIDEYYLDFGIRTVKVEGTKFLINGK<br>PFYFTGFGKHEDSEIAGRGYNPPVIKRDFELIKWVGANSFRTSHYPYSEEIMQAADRE<br>GIVIIDEVAAVGMFDVGSVLNPSASKTDYFSLDEVHSKTKEVHKKAVEELIKRDKNHP<br>SVVMWSLFNEPDTSKDEAVPYFEDIFNFAKSQDKQNLPKTFAAIDRSSPGKCKCMHL<br>CDVITLNRYYGWYFLGGYEIDMSEEKFREEMNLYSNMNKPVMFTEYGADTYAGVHK<br>LPSVMWSEEYQCEYYEMNFKVFDSYDFIVGEQLWNFADFQTTEGIFRVDGNKKGIFT<br>RNRQPKAVAHLIRSRWNKLPLDYKSKK<br>(BpQ451D/A452R) |
| 118 | MLYPVLTCSRLLSDLSGVWDFKLDNGKGFEEKWYEKPLKDADTMPVPASYNDLKEG<br>TDFRDHYGWVFYQRNICVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRKPKMVAHYFRNRWSTIPEFGYKTK<br>(EeQ8C/S73C) |
| 119 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGPDLEVSEIGLRKELSDWGKLGKPVMFTE<br>YGADTVSGLHDTTSVMYTEEYQVEYYEMNNKVFDEFDFVVGEQAWNFADFATSQSL<br>LRVQGNKKGLFTRDRCPKMVAHYFRNRWSTIPEFGYKTK<br>(EeK588C) |
| 120 | MLYPVLTQSRLLSDLSGVWDFKLDNGKGFEEKWYEKPLKDADTMPVPASYNDLKEG<br>TDFRDHYGWVFYQRNISVPEYVKSQRIVLRCAAVTHYAMIYLNGKLICEHKGGFLPFE<br>VELNDDLQDGDNLLTIAVNNVIDYTTLPVGGKANMMSGMMGGMGAGASDKPQNNP<br>NFDFFNYCGITRPVKIYTTPETYINDITVTADIDFTKEEPSAVLNYNVEIKGKDYNNITC<br>KVELFDEEGTKLSETEGSEGTFEISNVRLWQPLNAYLYKIKVTAGQDVYTLPYGVRSV<br>RVDGTKFLINEKPFYFKGYGKHEDTFPNGRGINLPMNTKDISIMKWQHANSFRTSHY<br>PYSEEMMRLCDEEGIVVIDETTAVGVNLQFGGGANFGGERIGTFDKEHGVQTQEHHK<br>DVIRDLISRDKNHACVVMWSIANEPDSAAEGAYDYFKPLYDLARELDPQKRPCTLVSV<br>QGTTADTDCSSQLSDVICLNRYYGWYFGGCDLEVSEIGLRKELSDWGKLGKPVMFTE<br>YGADTVSGLHDTTSVMYTEEYQVEYYEMNNKVFDEFDFVVGEQAWNFADFATSCSL<br>LRVQGNKKGLFTRDRKPKMVAHYFRNRWSTIPEFGYKTK<br>(EeP489C/Q570C) |
| 121 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE |

| SUMMARY OF SEQUENCE LISTING | |
|---|---|
| SEQ ID NO: | DESCRIPTION |
| | ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQEHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANLGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVPGNKKGVFTR<br>ERKPKAAAHTLKTRWSGMLGSDH<br>(Rxn3Y447L) |
| 122 | MLKPQQTTTRDLISLDGLWKFALASDDNNTQPWTSQLKTSLECPVPASYNDIFADSK<br>IHDHVGWVYYQRDVIVPKGWSEERYLVRCEAATMHGRIYVNGNLVADMVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANPGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3Y447P) |
| 123 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANIGDATYEVDRISDMF<br>DVLCLNRYFGWYSQTGEVEEAEAALEKELLGWEGKYGKPIVITEYGADTMAGLHSVL<br>ALPWSEEFQVQLLDMYHRVFDRIDSVVGEHVWNFADFQTAVGIIRVDGNKKGVFTR<br>ERKPKAAAHTLKTRWSGMLGSDH<br>(Rxn3Y447I) |
| 124 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANQGDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3Y447Q) |
| 125 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTtAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYEDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGHRVDGNKKGVFTR<br>ERKPKAAAHTLKTRWSGMLGSDH<br>(Rxn3G448E) |
| 126 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYKDATYEVDRISDM<br>FDVLCLNRYFGWYSQTGEVEEAEAALEKELLGWEGKYGKPIVITEYGADTMAGLHSV |

SUMMARY OF SEQUENCE LISTING

| SEQ ID NO: | DESCRIPTION |
|---|---|
| | LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3G448K) |
| 127 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYFDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3G448F) |
| 128 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYLDATYEVDRISDM<br>FDVLCLNRYFGWYSQTGEVEEAEAALEKELLGWEGKYGKPIVTTEYGADTMAGLHSV<br>LALPWSEEFQVQLLDMYHRVFDRIDSWGEHVWNFADFQTAVGIIRVDGNKKGVFTR<br>ERKPKAAAHTLKTRWSGMLGSDH<br>(Rxn3G448L) |
| 129 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVMDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYCDATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3G448C) |
| 130 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYWDATYEVDRISD<br>MFDVLCLNRYFGWYSQTGEVEEAEAALEKELLGWEGKYGKPIVITEYGADTMAGLHS<br>VLALPWSEEFQVQLLDMYHRVFDRIDSVVGEHVWNFADFQTAVGIIRVDGNKKGVFT<br>RERKPKAAAHTLKTRWSGMLGSDH<br>(Rxn3G448W) |
| 131 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGQATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3D449Q) |
| 132 | MLKPQQTTTRDLISLDGLWKFALASDDNNTQPWTSQLKTSLECPVPASYNDIFADSK<br>IHDHVGWVYYQRDVIVPKGWSEFRYLVRCFAATHHIGRIYVNGNLVADHVGGYTPFE<br>ADITDLVAAGEQFRLTIAVDNEITYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS |

| SEQ ID NO: | DESCRIPTION |
|---|---|
| | NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGGATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGHRVDGNKKGVFTR<br>ERKPKAAAHTLKTRWSGMLGSDH<br>(Rxn3D449G) |
| 133 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGRATYEVDRISDM<br>FDVLCLNRYFGWYSQTGEVEEAEAALEKELLGWEGKYGKPIVITEYGADTMAGLHSV<br>IALPWSEEFQVQLLDMYHRVFDRIDSWGEHVWNFADFQTAVGIIRVDGNKKGVFTR<br>ERKPKAAAHTLKTRWSGMLGSDH<br>(Rxn3D449R) |
| 134 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRFYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASHDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGKATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3D449K) |
| 135 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASHDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIWIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGSATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3D449S) |
| 136 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGCATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSVVGEHVWNFADFQTAVGIIRVDGNKKGVFTR<br>ERKPKAAAHTLKTRWSGMLGSDH<br>(Rxn3D449C) |
| 137 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNVVASTTQGTIQVAVIDEDGTTVATSSGS<br>NGTIHIPSVHLWQPGAAYLYQLHASIIDSSKKTIDTYKLATGIRTVKVQGTQFLINDKP<br>FYFTGFGKHEDSAVRGKGYDPAYMVHDFQLMDWMGANSFRTSHYPYAEEVMEFAD<br>RHGIVVIDETPAVGLAFSIGSGVSSEDSPQTFTPEGINNNTREAHKQAIRELIARDKNH<br>ASVVMWSIANEPASQEVGAREYFAPLVDLAHELDPSRPVCFANYGEATYEVDRISDM<br>FDVLCLNRYFGWYSQTGEVEEAEAALEKELLGWEGKYGKPIVITEYGADTMAGLHSV<br>LALPWSEEFQVQLLDMYHRVFDRIDSWGEHVWNFADFQTAVGIIRVDGNKKGVFTR<br>ERKPKAAAHTLKTRWSGMLGSDH<br>(Rxn3D449E) |

SUMMARY OF SEQUENCE LISTING

| SEQ ID NO: | DESCRIPTION |
|---|---|
| 138 | MLKPQQTTTRDLISLDGLWKFALASDDNNTQPWTSQLKTSLECPVPASYNDIFADSK<br>IHDHVGWVYYQRDVIVPKGWSEERYLVRCEAATHHGRIYVNGNLVADHVGGYTPFE<br>ADITDLVAAGEQFRLTIAVDNELTYQTIPPGKVEILEATGKKVQTYQHDFYNYAGLAR<br>SVWLYSVPQQHIQDITVRTDVQGTTGLIDYNWASTTQGTIQVAVIDEDGTTVATSSGS<br>NGTIHIPSVHLWQPGAAYLYQLHASHDSSKKTIDTYKLATGIRTVKVQGTQFLINDKP<br>FYFTGFGKHEDTNIRGKGHDDAYMVHDFQLLHWMGANSFRTSHYPYAEEVMEYAD<br>RQGIWIDETPAVGLAFSIGAGAQTSNPPATFSPDRINNKTREAHAQAIRELIHRDKNH<br>PSVVMWSIANEPASNEDGAREYFAPLPKLARQLDPTRPVTFANVGLATYKADRIADL<br>FDVLCLNRYFGWYTQTAELDEAEAALEEELRGWTEKYDKPIVMTEYGADTVAGLHS<br>VMVTPWSEEFQVEMLDMYHRVFDRFEAMAGEQVWNFADFQTAVGVSRVDGNKKG<br>VFTRDRKPKAAAHLLRKRWTNLHNGTAEGGKTFQ<br>(AoGUS: *Aspergillus oryzae* BGUS) |

SEQUENCE LISTING (139 sequences)

SEQ ID NO: 1 - protein, 604 aa, Aspergillus oryzae
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 2 - protein, 599 aa, Aspergillus terreus
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 3 - protein, 594 aa, Bacteroides fragilis
MKKLLAAAMLFMLNSWSCFSADTPRAEYPRPQFEREQWVNLNGTWTFDFDFGKSGKDRRLQSAEKFDKNITVPFCPESKLSGVGYTDFIEQMWYQRNITIPSDWNGKKIFLNFGAVDYCAEIYVDGKFVQRHFGGSSSFAVDLTRYVTPGKTHNLVVFVQDDLRSGLQTGGKQCGNYYSGGCSYTRTTGIWQTVWMEAVSADGLKSVFVRPDIDQKQLVIEPEFYNESANTLEITLKDRNKTVAKKSVNCANSSVVVLPVKNMKLWSPEDPFLYDLVYQVKDAKGNVLDEVKSYAGMRKVHTANGRFYLNNQPYFQRLVLDQGFYPEGIWTAPSDEDLKNDIVLGKEAGFNGARLHQKVFEERYYYWADKLGYITWGESASWMLDVNKELAARNFLGEWSEVVVRDRNHPSLVTWTPFNETWGGGPDAYIRLVRDVYNITKAIDPTRPVNDASGDNHVITDIWSVHNYEQDRAKLTEQLKMEEGKEPYRNARDKDFLAVYEGQPYMVDEFGGIPWMAEKDRKNSWGYGGMPENAEAFYKRLEGQIDAFIDSPHVTGFCYTQLTDVEQEKNGIYYYDRTPKLDMKRIKAIFEKIK

SEQ ID NO: 4 - protein, 603 aa, Bacteroides uniformis
MKTLLKNSLTFLLMLMPVLAFAQQAPQIMNVSARQTTSLDGQWKTIVDPFENGYYDYRLKPYDGGYAQDKTYSDKTKLQEYDFETDKLLFVPGDWNTQRPQLYYYEGTVWYRKHFEYSLQPGKRLFLNFGAVNYEAIVWLNGKRLGRHIGGFTPFNFEITNLLKEGTNSLVVKVDNKRLPEAVPTVNADWWNFGGITRPVTLIEMPATYIRDYYVQLAKDDKNMIEGWVQLEGSDKEQKITLDIPELKVKKEVTTDANGYASFLIKSKPILWTPENPKLYAVNLASETDKVSDEIGFRTIRTEGIKILLNDKEIFCRGISIHEETPYYSGRAYSKDHAHTLLSWAKELGCNFVRLAHYPHNEEMVREAERMGFLVWSEIPVYWTIHWENKDTYQNAEQQLCDMIARDKNRCNIIIWSIANETPHSETRLTFLSNLANKARSLDSVRLIGAAMEKEEVQPGVLTVNDPLGELLDIISFNEYVGWYDGDSEKCDRVNWTFDTQKPVFISELGGGALYGRHGSPKERFTEEYQEDLYIRHVNMLKRIPGLAGTTPWILKDFRSPRRHVPEIQDDFNRKGLVSDKGQKKKAFFVLQKWYKELTEAYK

SEQ ID NO: 5 - protein, 603 aa, Brachyspira pilosicoli
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 6 - protein, 601 aa, Brachyspira murdochii
MVNSMLYPRESRTRRVVDISGMWEFKIDSNNEGRKNGYANGLKDTTFIPVPSSFNDLFTDKNIREHAGDIWYETSFYLPLEWKDKNVNIRFGCATHEAAVYINGKEVCTHVGGFMPFNAPVNEAGIFGEKNKLVVVVNNELSNTTLPCGHTETKPSGKKYIKPSFDFFNYAGLNRPVKITVTNKEYIYDIDILSDINGSDGIVNYEVHTTGENKVFVKIYDEEGKEAASAEGKNGKIVIKNAKLWNPKAAYLYKFEACIKNGEELIDEYYLDFGIRTIKVEGTKFLINGKPFYFTGFGKHEDSETAGRGYNPPVIKRDFELIKWIGANSFRTSHYPYSEEIMQAADREGIVIIDEIAAVGMFDVGSVLNPGASKADYFSLEEVHTKTKEIHKKAVEELITRDKNHPSVVMWSLFNEPDTSKDEALPYFEDIFNFAKSIDKQNLPKTFAAIQASAPGKCKCMHLCDVITLNRYYGWYFLGGYEIDMSEEKFREEMNLYKDMNKPVMFTEYGADTYAGVHKLPSVMWSEEYQCEYYEMNFKVFDSYDFIIGEQLWNFADFQTTEGIFRVDGNKKGIFTRTRQPKAVAHYIRSRWTKLPLDYKK

SEQ ID NO: 7 - protein, 599 aa, Clostridium perfringens
MLYPIITESRQLIDLSGIWKFKLNEGNGLTEELSKAPLEDTIEMAVPSSYNDLVESQEVRDHVGWVWYERNFTIPKTLLNERIVLRFGSATHEAKVYLNGELLVEHKGGFTPFEAEINDLLVSGDNRLTVAVNNIIDETTLPVGLVKEVEVDGKKVIKNSVNFDFFNYAGIHRPVKIYTTPKSYIEDITIVTDFKENNGYVNYEVQAVGKCNIKVTIIDEENNIVAEGEGKEGKLTINNVHLWEPMNAYLYKLKVELLDDEEIIDTYFEEFGVRTVEVKDGKFLINNKPFYFKGFGKHEDSYVNGRGINEAINIKDFNLMKWIGANSFRTSHYPYSEEIMRLADREGIVVIDETPAVGLHLNFMATGFGGDAPKRDTWKEIGTKEAHERILRELVSRDKNHPCVVMWSVANEPDSDSEGAKEYFEPLIKLTKELDPQKRPVTVVTYLMSTPDRCKVGDIVDVLCLNRYYGWYVAGGDLEEAKRMLEDELKGWEERCPKTPIMFTEYGADTVAGLHDTVPVMFTEEYQVEYYKANHEVMDKCKNFVGEQVWNFADFATSQGIIRVQGNKKGIFTRERKPKMIAHSLRERWTNIPEFGYKK

SEQ ID NO: 8 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 9 - protein, 608 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 10 - protein, 611 aa, Eubacterium eligens
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 11 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 12 - protein, 603 aa, Lactobacillus brevis
MLYPMETASRVVLDLSGVWRFMIDKEQIPVDVTRPLPATLSMAVPASFNDQTASKEIREHVGYVWYERCFELPQLLRQERLVLRFGSATHEAWVYLNGHLITHHKGGFTPFEVEINDDLVTGENRLTVKLSNMLDYTTLPVGHYKETQNETGQRVRQLDENFDFFNYAGLQRPVKIYSTPHSYIRDITLTPKVNLTNHSAVVNGEIETVGDVEQVVVTILDEDNQVVGTTSGKTLAIELNSVHLWQPGKAYLYRAKVELYQAGQVIDTYIETFGIRQIAVKAGKFLINGQPFYFKGFGKHEDAYIHGRGLSEPQNVLDLSLMKQMGANSFRTSHYPYSEEMMRLCDREGIVVIDEVPAVGLMLSFTFDVSALEKDDFEDDTWEKLRTAEAHRQAITEMIDRDKNHASVVMWSISNEAANFSKGAYEYFKPLFDLARKLDPQQRPCTYTSIMMTTLKTDRCLALADVIALNRYYGWYMGNGDLKAAETATREELLAYQAKFPDKPIMYTEYGADTIAGLHSNYDEPFSEEFQEDYYRMCSRVFDEVTNFVGEQLWNFADFQTKFGIQRVQGNKKGIFTRAREPKMVVRYLTQRWRNIPDFNYKK

SEQ ID NO: 13 - protein, 648 aa, Mus musculus
MSLKWSACWVALGQLLCSCALALKGGMLFPKESPSRELKALDGLWHFRADLSNNRLQGFEQQWYRQPLRESGPVLDMPVPSSFNDITQEAALRDFIGWVWYEREAILPRRWTQDTDMRVVLRINSAHYYAVVWVNGIHVVEHEGGHLPFEADISKLVQSGPLTTCRITIAINNTLTPHTLPPGTIVYKTDTSMYPKGYFVQDTSFDFFNYAGLHRSVVLYTTPTTYIDDITVITNVEQDIGLVTYWISVQGSEHFQLEVQLLDEGGKVVAHGTGNQGQLQVPSANLWWPYLMHEHPAYMYSLEVKVTTTESVTDYYTLPIGIRTVAVTKSKFLINGKPFYFQGVNKHEDSDIRGKGFDWPLLVKDFNLLRWLGANSFRTSHYPYSEEVLQLCDRYGIVVIDECPGVGIVLPQSFGNESLRHHLEVMEELVRRDKNHPAVVMWSVANEPSSALKPAAYYFKTLITHTKALDLTRPVTFVSNAKYDADLGAPYVDVICVNSYFSWYHDYGHLEVIQPQLNSQFENWYKTHQKPIIQSEYGADAIPGIHEDPPRMFSEEYQKAVLENYHSVLDQKRKEYVVGELIWNFADFMTNQSPLRVIGNKKGIFTRQRQPKTSAFILRERYWRIANETGGHGSGPRTQCFGSRPFTF

SEQ ID NO: 14 - protein, 617 aa, Parabacteroides sp.
MKRISIAFLSLFLCVASVWSMPRPEYPRPQFERAGWVNLNGEWTCSFDFGGSGMEREFYKSKGFDKKITVPFCPESKLSGIGYTDFINHFWYQRPITIPQEWNGKNILLNFGAVYYKSEVYIDGVLASRHFGGTSSFAVDITSLVKPGQTHSLVVYVESDVRGAKQAAGKQNLQYASYGCNYTRTTGIWQTVWMEAVHPEGLQSIQLLTDIDQQQLVVRPRFYKEAGGKLQVTLKDNGKVVASRTVSASSLSSVVLPVKKMKTWSPESPFLYDLEYKVLDKNGNIIDEVNGYAGMRKVHIEGNKIYLNNKPYYQRLVLDQGFYPDGIWTAPSDEALKRDIELSMEAGFNGARLHQKVFEERFYYWADKMGYLTWGEASSWGMDCNDTETARNFITEWSEIVQRDRNHPSLLIWTPTNEEFWPDRVQYPRLMHDLYNLTKMIDPTRPFHGASGGTHIATDIWTVHNYEQDPAKLKEKLYNGGKLMEAPKWEIHLMPMNIGYNGLKYTDQYAFPEYKKDMPYLVDEFGGIKWNPSQQMESAQNTSWGYGEPPRSLEEFYARLEGQVDAVLSLSNDIWGYCYTQLTDVEQEQNGIYYYDRTPKFDMKRIHAIFSKTPESK

SEQ ID NO: 15 - protein, 602 aa, Staphylococcus sp.
MLYPINTETRGVFDLNGVWNFKLDYGKGLEEKWYESKLTDTISMAVPSSYNDIGVTKEIRNHIGYVWYEREFTVPAYLKDQRIVLRFGSATHKAIVYVNGELVVEHKGGFLPFEAEINNSLRDGMNRVTVAVDNILDDSTLPVGLYSERHEEGLGKVIRNKPNFDFFNYAGLHRPVKIYTTPFTYVEDISVVTDFNGPTGTVTYTVDFQGKAETVKVSVVDEEGKVVASTEGLSGNVEIPNVILWEPLNTYLYQIKVELVNDGLTIDVYEEPFGVRTVEVNDGKFLINNKPFYFKGFGKHEDTPINGRGFNEASNVMDFNILKWIGANSFRTAHYPYSEELMRLADREGLVVIDETPAVGVHLNFMATTGLGEGSERVSTWEKIRTFEHHQDVLRELVSRDKNHPSVVMWSIANEAATEEEGAYEYFKPLVELTKELDPQKRPVTIVLFVMATPETDKVAELIDVIALNRYNGWYFDGGDLEAAKVHLRQEFHAWNKRCPGKPIMITEYGADTVAGFHDIDPVMFTEEYQVEYYQANHVVFDEFENFVGEQAWNFADFATSQGVMRVQGNKKGVFTRDRKPKLAAHVFRERWTNIPDFGYKN

SEQ ID NO: 16 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEGEEMVLRFGSVTHQAKIYVDGILVGEHKGGFTPFEVLVPECKYNNEKIKVSICANNVLDYTTLPVGNYSEIIQEDGSIKKKVRENFDFFNYAGVHRPLKLMIRPKNHISDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDIGANSFRTSHYPYSEEMMRLADRMGVLVIDEVPAVGLFQNFNASLDLSPKDNGTWSLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGLRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 17 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 18 - protein, 609 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKTFQ

SEQ ID NO: 19 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 20 - protein, 607 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSDH

SEQ ID NO: 21 - protein, 612 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 22 - protein, 612 aa, Artificial Sequence; identical to SEQ ID NO: 21
  Description of Artificial Sequence: Synthetic polypeptide

SEQ ID NO: 23 - protein, 605 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKQGLCGR

SEQ ID NO: 24 - protein, 600 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSKQGLCGR

SEQ ID NO: 25 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 26 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 27 - protein, 606 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETPAVGLAFSIGSGVSSEDSPQTFTPEGINNNTREAHKQAIRELIARDKNHASVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSDH

SEQ ID NO: 28 - protein, 611 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGRHEDADLRGKGFDNVLMVHDHALMDWIGANSYRTSHYPYAEEMLDWADEHGIVVIDETPAVGLAFSIGAGAQTSNPPATFSPDRINNKTREAHAQAIRELIHRDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 29 - protein, 606 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKQGLCGR

SEQ ID NO: 30 - protein, 601 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDSAVRGKGYDPAYMVHDFQLMDWMGANSFRTSHYPYAEEVMEFADRHGIVVIDETAAVGFNLSLGIGFEAGNKPKELYSEEAVNGETQQAHLQAIKELIARDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSKQGLCGR

SEQ ID NO: 31 - protein, 604 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGSGVSSEDSPQTFTPEGINNNTREAHKQAIRELIARDKNHASVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 32 - protein, 605 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGSKTFQ

SEQ ID NO: 33 - protein, 599 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 34 - protein, 600 aa, Artificial Sequence
  Description of Artificial Sequence: Synthetic polypeptide
MLKPRQTPFRDLISLDGLWKFALDSGDNATAAPWTGPLTTDLECPVPASYNDIFVDRQIRDHVGWVYYQREAIVPRAWSQQQYLVRVDAATHQGRIYINDNLVAEHRGGYTPFEADITGLVSAGDSFRLTIAVNNELTHETIPPGRIEVEEYTGKRVQVYQHDFFNYAGLARSVWLYSVPQQHIQDIKVVTHVKGSAGLINYLVTVSNSTTGRVKIDVIDKDGTTVAEASGARGSVTIDSVKLWQPGEAYLYQFRASIVGLNDSVVDTYCVETGVRTVKVSGNRFLINDKPFYFTGFGKHEDSAVRGKGYDPAYMVHDFQLMDWMGANSFRTSHYPYAEEVMEFADRHGIVVIDETAAVGFNLSLGIGFEAGNKPKELYSEEAVNGETQQAHLQAIKELIARDKNHPSVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 35 - protein, 607 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 36 - protein, 607 aa, Artificial Sequence
  Description of Artificial Sequence: Synthetic polypeptide
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETPAVGLAFSIGSGVSSEDSPQTFTPEGINNNTREAHKQAIRELIARDKNHASVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQSILRVGGNKKGIFTRDRKPKSAAFLLQKRWTGMNFGEKPQQGSKQGLCGR

SEQ ID NO: 37 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 38 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDQFGGGANFGGERIGTFDKEHGSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 39 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDQFGGGANFGGERIGTFDKEHGSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 40 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGGGGANFGGERDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 41 - protein, 614 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGGKANMMSGMMGGMGAGASDKPQNNPNFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGGGGANFGGERDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 42 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 43 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLVGSVLNPSASKTDYFSLDEVHVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 44 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLVGSVLNPSASKTDYFSLDEVHVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 45 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFSVLNPSASKTIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 46 - protein, 602 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGCGHTETKPSGKKYIKPSFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFSVLNPSASKTIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 47 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYATGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 48 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYITGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 49 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYVTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 50 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 51 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYLTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 52 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYWTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 53 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYWKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 54 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYSKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 55 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFAGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 56 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFCGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 57 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFFGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 58 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFIGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 59 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFKGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 60 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFSGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 61 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 62 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFAGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 63 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFVGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 64 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAFQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 65 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAKQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 66 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAALQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 67 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 68 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAQQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 69 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAADQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 70 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAVQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 71 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSFQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 72 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSLQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 73 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSWQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 74 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSCQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 75 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSGQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 76 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSEQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 77 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 78 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIEASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 79 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIGASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 80 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAISASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 81 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIVASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 82 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIKASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 83 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQDSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 84 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQKSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 85 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQNSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 86 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQGSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 87 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQESSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 88 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQQSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 89 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQATTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 90 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQHTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 91 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQNTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 92 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQSTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 93 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEEIFRVDGNKKGIFTRNRQPKAVAHLIRSRWNKLPLDYKSKK

SEQ ID NO: 94 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEAIFRVDGNKKGIFTRNRQPKAVAHLIRSRWNKLPLDYKSKK

SEQ ID NO: 95 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEDIFRVDGNKKGIFTRNRQPKAVAHLIRSRWNKLPLDYKSKK

SEQ ID NO: 96 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEYIFRVDGNKKGIFTRNRQPKAVAHLIRSRWNKLPLDYKSKK

SEQ ID NO: 97 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQGLLRVQGNKKGLFTRDRKPKMVAHYFRNRWSTIPEFGYKTK

SEQ ID NO: 98 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQNLLRVQGNKKGLFTRDRKPKMVAHYFRNRWSTIPEFGYKTK

SEQ ID NO: 99 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVVIIRVDGNKKGVFTRERKPKAAAHTLKTRWSGMLGSDH

SEQ ID NO: 100 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVEIIRVDGNKKGVFTRERKPKAAAHTLKTRWSGMLGSDH

SEQ ID NO: 101 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYCGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 102 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYIGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 103 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 104 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYFGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 105 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYMGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 106 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYYKGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 107 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAALQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 108 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 109 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAYQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 110 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFVGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAVQASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 111 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAMDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 112 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAQDASSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 113 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDESSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 114 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDGSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 115 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDQSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 116 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDSSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 117 - protein, 603 aa, Artificial Sequence
  Description of Artificial Sequence: Synthetic polypeptide
MVNSMLYPRESRTRRVVDISGMWEFKIDINNEGRNSGYANGLKDTTFIPVPSSFNDLFTDKNIREHAGDVWYETSFYLPLEWKDKDVNVRFGCATHEATVYINGKEVCTHVGGFMPFNAPVNEAGIFGEKNKLVVVVNNELSNTTIPCGHTETKPSGKKYIKPSFDFFNYAGLNRPVKITVTNKEYIHDIDILSDVNGSDGIVNYEVHTTGENKVYIKINDEEGKEVASCEGKSGKIVIKDAKLWNPKAAYLYKFIACIKNGDELIDEYYLDFGIRTVKVEGTKFLINGKPFYFTGFGKHEDSEIAGRGYNPPVIKRDFELIKWVGANSFRTSHYPYSEEIMQAADREGIVIIDEVAAVGMFDVGSVLNPSASKTDYFSLDEVHSKTKEVHKKAVEELIKRDKNHPSVVMWSLFNEPDTSKDEAVPYFEDIFNFAKSQDKQNLPKTFAAIDRSSPGKCKCMHLCDVITLNRYYGWYFLGGYEIDMSEEKFREEMNLYSNMNKPVMFTEYGADTYAGVHKLPSVMWSEEYQCEYYEMNFKVFDSYDFIVGEQLWNFADFQTTEGIFRVDGNKKGIFTRNRQPKAVAHLIRSRWNKLPLDYKSKK

SEQ ID NO: 118 - protein, 611 aa, Artificial Sequence
  Description of Artificial Sequence: Synthetic polypeptide
MLYPVLTCSRLLSDLSGVWDFKLDNGKGFEEKWYEKPLKDADTMPVPASYNDLKEGTDFRDHYGWVFYQRNICVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRKPKMVAHYFRNRWSTIPEFGYKTK

SEQ ID NO: 119 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGPDLEVSEIGLRKELSDWGKLGKPVMFTEYGADTVSGLHDTTSVMYTEEYQVEYYEMNNKVFDEFDFVVGEQAWNFADFATSQSLLRVQGNKKGLFTRDRCPKMVAHYFRNRWSTIPEFGYKTK

SEQ ID NO: 120 - protein, 611 aa, Artificial Sequence
  Description of Artificial Sequence: Synthetic polypeptide
MLYPVLTQSRLLSDLSGVWDFKLDNGKGFEEKWYEKPLKDADTMPVPASYNDLKEGTDFRDHYGWVFYQRNISVPEYVKSQRIVLRCAAVTHYAMIYLNGKLICEHKGGFLPFEVELNDDLQDGDNLLTIAVNNVIDYTTLPVGGKANMMSGMMGGMGAGASDKPQNNPNFDFFNYCGITRPVKIYTTPETYINDITVTADIDFTKEEPSAVLNYNVEIKGKDYNNITCKVELFDEEGTKLSETEGSEGTFEISNVRLWQPLNAYLYKIKVTAGQDVYTLPYGVRSVRVDGTKFLINEKPFYFKGYGKHEDTFPNGRGINLPMNTKDISIMKWQHANSFRTSHYPYSEEMMRLCDEEGIVVIDETTAVGVNLQFGGGANFGGERIGTFDKEHGVQTQEHHKDVIRDLISRDKNHACVVMWSIANEPDSAAEGAYDYFKPLYDLARELDPQKRPCTLVSVQGTTADTDCSSQLSDVICLNRYYGWYFGGCDLEVSEIGLRKELSDWGKLGKPVMFTEYGADTVSGLHDTTSVMYTEEYQVEYYEMNNKVFDEFDFVVGEQAWNFADFATSCSLLRVQGNKKGLFTRDRKPKMVAHYFRNRWSTIPEFGYKTK

SEQ ID NO: 121 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANLGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 122 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANPGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 123 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANIGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 124 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANQGDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 125 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYEDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 126 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYKDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 127 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYFDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 128 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYLDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 129 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYCDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 130 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYWDATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 131 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGQATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 132 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGGATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 133 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGRATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 134 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGKATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 135 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGSATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 136 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGCATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 137 - protein, 597 aa, Artificial Sequence
  Description of Artificial Sequence: Synthetic polypeptide
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDSAVRGKGYDPAYMVHDFQLMDWMGANSFRTSHYPYAEEVMEFADRHGIVVIDETPAVGLAFSIGSGVSSEDSPQTFTPEGINNNTREAHKQAIRELIARDKNHASVVMWSIANEPASQEVGAREYFAPLVDLAHELDPSRPVCFANYGEATYEVDRISDMFDVLCLNRYFGWYSQTGEVEEAEAALEKELLGWEGKYGKPIVITEYGADTMAGLHSVLALPWSEEFQVQLLDMYHRVFDRIDSVVGEHVWNFADFQTAVGIIRVDGNKKGVFTRERKPKAAAHTLKTRWSGMLGSDH

SEQ ID NO: 138 - protein, 604 aa, Aspergillus oryzae
MLKPQQTTTRDLISLDGLWKFALASDDNNTQPWTSQLKTSLECPVPASYNDIFADSKIHDHVGWVYYQRDVIVPKGWSEERYLVRCEAATHHGRIYVNGNLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVIDEDGTTVATSSGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPIVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGGKTFQ

SEQ ID NO: 139 - protein, 6 aa, Artificial Sequence
  Description of Artificial Sequence: Synthetic 6xHis tag
HHHHHH

What is claimed:

1. A chimeric beta-glucuronidase (BGUS) enzyme comprising an N-terminal sugar-binding/Ig-like domain (SBI domain) and a C-terminal TIM-Barrel domain (TIMB domain), wherein the SBI domain comprises a Counterloop domain and the TIMB domain comprises a Loop 1 domain, wherein the chimeric BGUS enzyme comprises at least one domain selected from SBI, TIMB, Counterloop or Loop 1 from a first BGUS enzyme operatively linked to at least one domain selected from SBI, TIMB, Counterloop or Loop 1 from a second BGUS enzyme, wherein the chimeric BGUS enzyme is at least 98% homologous to the amino acid sequence of any one of SEQ ID NOs: 19, 26, 31, 40 and 45 and exhibits:
   (i) an increased level of enzymatic activity for one or more substrates as compared to the first or second BGUS enzyme; or
   (ii) an increased effective range of substrates catalyzed as compared to the first or second BGUS enzyme; or
   (iii) an increased effective pH range for one or more substrates as compared to the first or second BGUS enzyme; or
   (iv) an increased effective temperature range for one or more substrates as compared to the first or second BGUS enzyme; or
   (v) an increase in enzyme stability as compared to the first or second BGUS enzyme; or
   (vi) any combination of (i)-(v).

2. The chimeric BGUS enzyme of claim 1, wherein the first and second BGUS enzymes are each from a species independently selected from the group consisting of *Aspergillus oryzae*, *Aspergillus terreus*, *Bacteroides fragilis*, *Bacteroides uniformis*, *Brachyspira murdochii*, *Brachyspira pilosicoli*, *Clostridium perfringens*, *Escherichia coli*, *Eubacterium eligens*, *Homo sapiens*, *Lactobacillus brevis*, *Mus musculus*, *Parabacteroides* sp., *Staphylococcus* sp. and *Streptococcus agalactiae*.

3. The chimeric BGUS enzyme of claim 2, wherein the first BGUS enzyme is from *Aspergillus oryzae* and the second BGUS enzyme is from *Aspergillus terreus*.

4. The chimeric BGUS enzyme of claim 2, wherein the first BGUS enzyme is from *Brachyspira pilosicoli* and the second BGUS enzyme is from *Eubacterium eligens*.

5. The chimeric BGUS enzyme of claim 1, which comprises an SBI domain from the first BGUS enzyme and a TIMB domain and Loop 1 domain from the second BGUS enzyme.

6. The chimeric BGUS enzyme of claim 5, which comprises the amino acid sequence shown in SEQ ID NO: 19.

7. The chimeric BGUS enzyme of claim 1, which comprises an SBI domain from the first BGUS enzyme, a TIMB domain from the second BGUS enzyme, and a Loop 1 domain from the first BGUS enzyme.

8. The chimeric BGUS enzyme of claim 7, which comprises the amino acid sequence shown in SEQ ID NO: 26.

9. The chimeric BGUS enzyme of claim 1, which comprises an SBI domain and a TIMB domain from the first BGUS enzyme and a Loop 1 domain from the second BGUS enzyme.

10. The chimeric BGUS enzyme of claim 9, which comprises the amino acid sequence shown in SEQ ID NO: 31.

11. The chimeric BGUS enzyme of claim 1, which comprises:
   (a) a TIMB domain from a first BGUS enzyme, a Counter-loop domain from a second BGUS enzyme and a Loop 1 domain from the first BGUS enzyme; or
   (b) a TIMB domain from a first BGUS enzyme, a Counter-loop domain from the first BGUS enzyme and a Loop 1 domain from a second BGUS enzyme; or (c) a TIMB domain from a first BGUS enzyme, a Counter-loop domain from a second BGUS enzyme and a Loop 1 domain from the second BGUS enzyme.

12. The chimeric BGUS enzyme of claim 11, which comprises the amino acid sequence shown in SEQ ID NO: 40 or 45.

13. A formulation comprising the chimeric BGUS enzyme of claim 1 and at least one excipient.

14. The chimeric BGUS enzyme of claim 1, which further comprises an amino acid substitution, as compared to the first BGUS enzyme or the second BGUS enzyme, at an amino acid position corresponding to Q451 of SEQ ID NO: 5.

15. The chimeric BGUS enzyme of claim 1, which further comprises an amino acid substitution, as compared to the first BGUS enzyme or the second BGUS enzyme, at an amino acid position corresponding to A452 of SEQ ID NO: 5.

16. The chimeric BGUS enzyme of claim 1, which further comprises amino acid substitutions, as compared to the first BGUS enzyme or the second BGUS enzyme, at amino acid positions corresponding to Q451 and A452 of SEQ ID NO: 5.

\* \* \* \* \*